United States Patent 12,790,634 (MOST PROBABLE NUMBER ANALYSIS OF HETEROGENOUS POPULATIONS) - sequence listing, part 22

SEQ ID NO: 15 - DNA, 6232105 bp, unidentified (residues 1-2,077,369 of 6,232,105)
  source 1..6232105: mol_type = genomic DNA; note = Enterocloster asparagiformis
caaaaaagtttttaaaaaagttgttgacaaacgctagcgagtgtgctaagatataaaagttgctgctaacgaagaacaacaacaaagaaccttgaaaatcaaagattgaacagtatgtaaaaccctgaaaattctaaaaaataaaggtctggtttagacctttggatttgagaaaattcagaacaaaaccaagtaatgaaggttaaagataactagccaagctaagtagtctaagaccaagaatcaacttttaatttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtgccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaagaagaagtaagggttttatatactgttgaatcttggatttgccaaggtaaaaaatttccggtggcgatgcgcttgagggaaacacccgttcccatcccgaacacgatggttaagactcaagcggccgatggtactatgctggtgacggcatgggagagcaggtggctgccggatttattaagggcttatagctcagccggttagagcgcacgcctgataagcgtgaggtcggtggttcgagtccacttaagcccactgcccagacgttcgtatacttgggtgagtggatatagaaaatacatagagatcgcctcgaaagaggggaaacccatatttcgcgattgtgagatattgctcgattggtcgggcgcttgctttacaggcaaggggttaggagttcgaagctctccgtctccattcgaaatcatctaataaatgatttcaaaaatatgtaccttgaaaaccgcatattgaatgaaaatgaattgaatattctatagaataatcaagacatccgagggatacatcgaaagatgtatcaaatgtaacaaacctaagaccaaacgatccaacgctatggattgtcgatgagtcggagcaacccgcaccgacgagtcattttggttaagctataaagagcgcagggtggatgccttggcactaagagccgatgaaagacgtgataagctgcgaaaagcttcggggaggagcaaatatcctttgatccggagatatctgaatggggaaacctggctgagtaaccctcagtcgacgtatggtgaatacatagccatacgctgggaacccggtgaactgaaacatctaagtagccggaggaagagaaagaaaaatcgattcccaaagtagcggcgagcgaaatgggaagagcccaaaccagcgtgcgtgcacgctggggttatggactgcataagcgagctgattcgttagtggaactgtctgggaagtcagaccaaagagagtgaaagtctcgtacacgaaagcgataggcagcggcaggatccagagtaccacgagacacgtgaaaccttgtgggaagtcggagggaccaccctccaaggctaaatactccttagtgaccgatagcgcatagtactgtgaaggaaaggtgaaaaggaccccgggaggggagtgaaaaagaacctgaaaccctgtgtttacaagctgtggaagcacgttaaggtgcgaccgcgtactttttgtagaacggtccggcgagttgccggtactggcaaggttaagtggttaagccacggagccgaagggaaaccaagtctcaaatgggcgtaaagtcagtacaggcagacccgaaaccgggtgacctatccatgtccaggttgaagcggaagtaaaattccgtggaggaccggatccacatccgttgaaaagggtgggaatgaggtgtggataggggagaaattccaatcgaacccggagatagctggttctcctcgaaatagctttagggctagcctcatattagtttagcggaggtagagcactgaattcctaagggggcgtcaaagcttaccaagggatatcaaactccgaatgccgtataaatgatgtatgggagtcagactgcacgagataagttgggtagtcaaaagggaaagagcccagacctacagctaaggtcccaaagtgtgtgttaagtggaaaaggatgtgggatttcagagacaactaggatgttggcttagaagcagccacacattcaaagagtgcgtaatagctcactagtcgagaggtcctgcgccgaaaatgtccggggctaaaacacaacaccgaagcttaggaatcacttttagtgattggtagaggagcattcttaaaggaacgaagcagtaccgacaaggagctgtggacttttaagaagagagaatgccggaatgagtagcgagatggaggtgagaatcctccaggccgaatatccaaggtttccagagtaaagctgatctgctctgggtaagtcggggcctaaggcgaggctgaaaagcgtagtcgatggacaacaggttgaaattcctgtaccgcgtattatcagaactgtggggacgcagaaggacaacacaacccgggaatgggaagaccggggcaagcgaggtaggagtatggttggcaaatccgccatacaatccgaagacgtgacgcgtagcgaactataagtagcgaagtgtgtgattccggctgccaagaaaagccgctattgtgtaatacgtgcccgtaccgtaaaccgacacaggtagatgaggagagaatcctaaggccggcgggagaagcattgttaaggaactcggcaaaatgaccctgtaacttcgggataaagggtgccagagagatctggccgcagagaataggctcaagcaactgtttagcaaaaacacaggtctatgcaaaaccgaaaggtgaggtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagcttgatactgggattcggtattgcatgtacaggataggtgggaggctaagaagcatggacgccagtctatgtggagccaatgttgggataccacccttgcgatattgggtttctaacctgcagccgtgacccggctgggggacaatgtcaggtggggagtttgactggggcggtcgcctccgaaagggtatcggaggcgctcaaaggttccctcagaatggttggaaaccattcgcagagtgcaaaggcataagggagcttgactgcgagaccgacgggtcgagcaggtacgaaagtaggacttagtgatccggtggtagaaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcgtaggatatttgagaggagctgtccttagtacgagaggaccgggatggacggaccgctggtgtatctgttgggtaccaagcccatggcagagtagccaagtctggacgggataaacgctgaaggcatctaagcgtgaagcccccctcaagatgagatatcccatagcgaaagctagtaagaccccttgaagacgacgaggtagataggttagaggtggaagtgcagtaatgtatggagctgactaatactaatcggtcgagggcttaaccaaaacggtataggttttaaacatcattcaatatgtggttttgagggtatgtattttttgcatataaaagcaaaagttgcatatactaataaagaaggtacttgaagaatcttagattatagggtataattaagactcggaaagcacttactattcctcgatagctcagtcggtagagcacgcggctgttaaccgcgctgtcgtaggttcgagtcctactcggggagttttttagtggagtccatggtgaccactagtcgggccccatggtcaagcggttaagacatcgccctttcacggcggtaacacgagttcgaatctcgttggggtcatcaagcatatatggcgacatagccaagaggtaaggcgcgggtctgcaacacccttatcaccggttcaaatccggttgtcgcctctacaaaatcccggaacattgttcccgggattttttgttgtatcaggactatccggtatcggtgtggggcagcgacaaaggacttccggtggtaggatatccccgtgcgtttacaatcctgggagctgtgacggtgttgctgatttccggctaccggtactaccgaagaatgagaggcgtgccggaggccatcgggcagctggcttccaggggcagcgtgcatctcacctgcggttctccggtatatcaacgaggacgtgcagcccaatggagacatccatgtgatgggcctgcgcattgtgcggcggattttaacgctgtttctcaaggcaacggggagacctgttgcttttttatgttgtttaactccatatattggagtatgatagatcgtagatagggtatttgcggaacaagttaacagcggctggagataagatatgatgaagcgggatacgatcctgattgtggatgatatggaggtcaaccgtgcgattttgcacggggtgttcgagacgcagtacaatttgctggaggcggagaacggggagcaggcgctgctgttgctggaggcgtaccacggccagattgccgctctgctgctggacctgatgatgccggttatgaacgggtatcaggtgatggaggagatgcgggaacggggggaattcacagatgttccggtggtggtgatcacggcggaggattcggtggaacacgaggtcagggcctttgacctgggggcctccgatatcgtgaaaaagccctttgagccccatgtggtcaaacggcggatccagaacattatcgagctgaacctgcaccggctgaaccaggaggagctgatcgccgaacaagcggccaggctgcgggaatccaacgccgtgatgatcgacgccctgtcctccattatcgagtaccggagcgtggagaccgggcagcatatccagcggatccgcatgtttgccaaggtgctgctggaggacgtgtcgcgctgctatgcagagtacggcctgaatgagcaaaacatagacatgatcgccagcgcgtcgtccatgcacgacatcggtaaaatcgcgattccggactcgattctcaacaaaccgggacgattgacgccggaggaatttgagatcatgaagacccattcggtgaagggctgtgagattctggcgggcctggaccggatgagcgatcaggagtatttgcagtacgcctacaacatttgccgttatcaccacgagcggtgggatggttccggctaccccgacggacttaagggggacagcatcccggtctgcgcccaggtggtggggatcgccgactgctatgacgccctgactaccgatcgggtttatcggaaggccctgcctgccggccaggccgtcaatatgattttaaacggggagtgtggggcattttcccccaaacttctggagtgcctgaaaaatgtgcaggagccgtttaagcgtctgtcccaggagtacgcggacggagcatcggccaggaaggactgtatcagtcccacgagagcgggataccacagggagcaggacccgctggatacgcttcagatggggcagatgaagtatttttccctgttaaaatatacggattccacggtcatggaggtggatatgaccaacggagtctaccatgtggtctatatgccggacagcgcctttgagctgttgcgctccggcagcagttttgcggagtcggtggcaaattttgcggatgcgctggttcacccggaggaccgggggctggtgaaaaagctttccggccggtatatggaagcatttttcgaaaacggacttacacgccgcagctaccgcttccgcgtgtttaaccccctgagggagaaataccgctggtgccagattacgctgcttcggatcgactgcggacaaccgcatcagcgcagcgcgctggtgatctggcaaccggagacggagagcgcggccccgctcaaggtgatggagccggccggaaccggtctgctgcacaacctggtgggagggatccagcagtgtctcaacgaccgctggttcaccctggtgcaggtaaacgagggatttatgcagatgctgggatatggggaccaggagctgcgaagcaagttccagaaccgttacctcaatctcatttaccccgccgaccgcgaggaggtgctgcgccagacgaaagaacagctgcagtccggcagcacggtggagctggaataccgggtggtggcccgggacgagcggattgtgtgggtgcttgataagagccagctgacggtgggcgaggacggaaaggagtccctgttcagcattttgatcgatattaccaggtcgaagaaggctcaggatgagctgcggctgacgctggagcgccacaagatcattatggaccagaccaacgatgtgattttcgagtgggatatcggaaaggatcagctctcctactcgcccaactgggtggagaagtttggctatgtacccatcatggagcaggccagcaagcggatggtgcaggtgtcccacatacacccggaagatatgcccatgatcgatcggctggtgaagcggattagggccgggcaggcgtacggggaagcgcagttccgtctggcggacgcaaagggccgttaccgctggtgcaagatccgcacctcgacccagttcgacgatatgggaaatacttacaaagtggtgggcgtgatgacggacatcgacgaggagaagcgggcggcccaggcgctgattgacaaggcggaccgcgacgagctgaccggtctgtataacaagagcgcagtccgccggaagatggaggattatcttcagagacggccgaaggatgagtccgcggtgatatatatcattgacgtggacaattttaagcagatcaacgacggccacgggcacatgttcggcgacacggtgctgcaggccatttccgggaagctgcgggaagtgttccggggccaggacctgatcgcccggatcggcggggacgagtttctggtgtttgtgcggggcatgccggatcccgcggctgccgagagacgggcgatgacgatccgggacggggtcggcgggcttttccggcaaaatgtgatacaatgcaaagtttcctgcagcatcggcatcgcccgctgtcccgaaaatggaaccacattcgacgaattgttccagcggggggacatggcgctgtactactctaaggcaaagggcaaggaccggttcgcactgtatgatcaggaacagatgagccgcttgtttgacgggaacgggggctacaggacggccaataccaccatcgaccccagggagaccacggatattgtcaccggtgatgtgatggagcaggtgttccgtctgctctgcgacgcggatgacatccaaaaggcggtggaacatatattggatatgctgggacgccagttcgcggtcagccgcgcctccatctatgaggtgtcgccggatggcggtctaatcagcaacgcattcgagtggtgcaatgagggcgtggagtccgggaacggccggggacagaaaaaaagcgacggacggctgatccgggaggtacacgcgcagttcgatgccggcggagtctggcattgcccggatatttccggtctgaaggaaaccatacgccggcattttgagcggcgggggacaaagtccatgcttcagtgtgagatatccgaccggggaatttaccggggagccatcgtgtttgaggattgcgccatgcaccggatctggacggaggagcagattcacatgctggcctttgtggcaaagctgctcagcgtatttttgattaaagagcgggcgcggtgccaggcggcggatggagccggccgggaacctgtggcggaatccgccggggagaccggttctgaaacggcatccggattgaaattttgatttgatattgacatatgtcattaattcggctataatttatgacataagtcaaaaacagctgcgaggagaatgaacatggcgcgtccctgtaaagcaaaacgagtctgtgcgatgccatccgtggaggttttcggtcctctggatcaggagaccgacggcaaggtggagctgacgctggaggaatatgagacaatccggctgatcgatctgctggaatgcacccaggaggagtgcgccatgcagatgggggttgccaggaccacggttcaggcggtctacaatacggcgcgcaggaagatcgccgactgtattgtcaacggaaggggattggagatccggggaggaaactatcagatctgcccgggcgcagcccagtgctgcggccggaactgcggaaaacgccaatgccacgcccgccgctgtgaaaacaaatcaggaggatgtcagaatgaaaattgcggtaacatatgagaatcaagaggtattccagcactttgggcactgtgaggctttcaagatctacgagatagcggacaatgcagtggtttcgtccgaggtggtgggcacaggcggcgacggccatgaagcgctggcaggatttctgagaaggcacggcgtggatacgctgatctgcggcggaatcggcggcggcgccagaatggctctggctcaggcggggattgagctttaccccggcgtgaccggagatgcggacgcggcggtggaggcgctgctgaagggatgcctggactacaatccggacaccatgtgcaaccatcaccacgagggcggcgagcaccacagctgtcatggaaacggccatacctgcggcggacatatgtaaaacggtacagcgcctggcggaagaaattccgccgggcgttttttgaatgcaatgggccgctggcccagccggcgggcgattgtacatgtttgggaaaatggggatgataaataatggaatttgcaacttttggccatataaaataatctatagatcagaagataaaaatcctactggaaaacagagagggaagggcgcctgatgaaaaaggatctgtacgataaaattgtaacccatattgttgaaaaccaggaaaagttttaccggttggcgttcagctatgttaaaaataaggacgacgcgctggatgtagtgcagaactcagtgtgtaaagcgctggatcattatgaatcgctgcgaaacgaggaggcggttaagacctggttttaccgcatccttgtgaatgaaagcgttcattttttgaacaggcggaaacgggaggttttgtccggcgaagattacgatgaacagattccttattatgaaaaacgatatgaggcggaggatgatctggaggcgcagattgaccggttggaggaggatgtccaaaagattatcagactgcgattctatgaggaattgtcgctgaaggagatttcccaggtgatggaactcaacttaaatacggtaaaggcaaagctgtaccggggcttaaagctgttaaagcagattgtacaggaggtggagtgatgagtcagttgaacgacagcaagaaacgctatgatgagatcccgattccggaggagctttccgcgcgcgtgcaggaagcgattgaacagtctgagaaaaagcgggcggatgagcgcagggcagccgcgctgaatcgtaaaaacggtttgaaaaaagggatgatggcagccgcggctgcggtggttgtgtttaccactgcgttaaataccagcacggcgtttgccaagagcgtaagcgcgattccggtgatcggggagattgcaagggtcttaaccttccgctcctatgaacaggaggaagatgatataaaactctcggtggaaattcccagtgtggagatgattgcggactccacaggtcaggcgccggactctgtcaaccgccagatttaccagctctgtgagcaatacgccggcgaggcgaaggagcgggccatggaataccggcaggcgtttctggataccggcggtacgctggaggagtgggcggctcataagcttgagattcgcgtctggtatgagattaagtctcagactgagaattacctgtcgctgatggtgtccggcagcgagagctggtcatccgcttatggggagacgaggtattataacattgatttaaagagcggaagtctggtgacgctgaaggatctattgggggatgattacgccgacatagtaaatacgagtatacgcgaacagatgaagcagcggacggacgtaacattctggacgcctgagcagggcggatttacgggcatttccgatcatgtccggttttatatcaatgctgcggatcacccggtgattgttttcgaaaaatatgagattgcgcccggttcagaaggtcagccggagtttgaaattcaggggtaaacgggtgggactggtctttgccgtatgattgtttatggtttttttagaataaaataattgaccacatggtctatttgaagtatactgaatattaaaatagaccatgtggtcaattattggagagtgattctatgaaacgggaagagaagaaccggcagaccagacagcggattatggacagcgctttgcaggagtttgcccggcaagggtacggggccagctcggtcaatgcgatttgcagcgccgaggggatatccaaggggattatctaccactattttgagacgaaggacgagctgtatctggcgtgtgtggaggattgttttcaacggctgacggagtacctgcgggaggccatgccgcagagcggccggggaacgcaggaatgtctggaactatattttaatgccaggatggagttttttcaaaaaaatccgttgtatcagcgtatcttctgcgatgtggtgattttgccgcccgctcatttgaaaacggctgtgggagaacggaaagcggggtttgacgcgctgaatattgagattctgatgcggattctggcggggatgaagctgcggccggagatttcccgatgggaggcggttgatacgtttctgcagtaccaggattttctgaacgccagatatcagatggcgggagccggggaggttgatattcggaagcatgagacggattgccaccgggcgctggaaatcctgctttatggggtgacggcgagagaggaggcgcagcggtgaaaaacagacagaacagccaggaatccatattaggggagatgaagccgtccagggccatcacaagcctggcaatcccggcaaccctggctttattagccaaggcggtatacaatattgtggacacggcttacatcggcatgctggattccgatgtcgcgctggctgccgtgggtgtgacgcttcctctgctgctgatcatggtgagtattgaaaatatttttgccgccggagcggctgtgctggccggacggcagctgggggcgggggaccgggacggcgcggggagaaccgtgacctccgtggtggggatttcgatgttcatcggcatgggcctgtgtatcggtggaatcctgtttatggaaccgcttctaacggcctttggggcttcggaggcggtgctgccccaggcgaaagaatatgcattttggatgtttgtggcggcgttggcgaatcttccggcccagagtatgaactgtgcggcgagagcggaatcgtcggtccgaatctcctctgtggccgtgattacgggagcggcgctaaacgtggtcttggacccggtttttatgtttgactggggattggggctgggagtgggcggcgcatccttagcgaccacggtttcgcagtttgtcacgtttttgatcctggcctggttctatctgtgcggccattccataatcaagattaaacgcgtttatttcaggccggattggaagctggtgaaggaggtcacgctgatcgggattccaacggcagtcatccagatctgcctggccgtggccacgtccctgaccaacattgccgccaaacccatggcggatgcggatttgattatcgccgcctatggagtggtgcagaggctgattctgattggctgttatgtggtgatgggatttatgcagggatatcagccggtggcgtccttctcgttcggaggcgctaaggaggagcgctttcacgagtccgtgcgctttgccctgcgcgcgtccctggtgctgacggtttttgttgcagcctgctatatcctgctgtgccggccgttaatcgggctgtttaaccgcaacccggccgtgatcgattacggggcaaagctgctggtgtcccaggtggccctttatccggcttttgggctctgttatatgatgaccattaccttccagaccattggggcttcaaagtacgggttgtttctgtccatgatccgccaggggctgctgtacgtgccgtttattctgctgctgccccgccagatgggcgtggcggggatttatctggcccagccggctgcagatcttctgaccattgcggtttgcctgatgtcggtcaggccgatgaagcggattgcgtccgaacatatggcggcggcatagcggattccgtcagcctgcggggaaaattcctctacggtgcgcgcagggtttccatattttgttaatttaaaatgttcaaattccagaccgggctgcagaggcggatttcggtctggaattttattgagtgcattgggccgcgggggactcccgttggccgcttttttgtaaatgcagaaattgatagttgacatttttagaattctgtatataatgtaaatataaacatatgaacaattattcatatgataatacaaacagacgaaccaattaatgacaggatacaggaaaggggggttatgatggcgatcaacgacgtggagtgctgtgatttttatcaggtgcatgaggatgtggtaaaagccgtgaatgagaagatgcctgatgaggatgaactgtgcgatctggcggagattttcaaggtgtttggggattccaccaggatcaagattctgtacgtgctgttcgaggcggagatgtgcgtctgcgatatcgcgcagctgctcaatatgaaccagtccgccatatctcaccagctgcggattctcaagcagaaccggctggtaaagagccgcagggagggcaaggcggtgttttattccctggccgacggccatgtgcggaccattatcaatcagggtctggagcacattcaggaataggcggagcgtataaaataaattaaaaagcggaggatattgatatgaagaagaagtttaaactgacggatctggattgcgccaactgtgcggctaagatggaggatgccatccggaagatcgagggcgttgagaacgccagcgtgagctttatgacccagaagatgaccattgaggcggctgaggatcagtttgaccgcatcatgcaggaagtggttgcggtgtgcaaaaaggtggagccggactgcgtgattaatctgtaatgcggctgaggaggcttgagaggaacgaattatgacgaagaagcagaataccatggtgtttcgtattgttgcgacgtttatcatttatataccgctggcggtagcggagcatatggaattgcttgcagccaagggatcgctgtcatggcttgcgctgtatctgattccgtatttactgatcggctgggatatcatttacaaggcgttgagaaatatccgcaacggtcaggtatttgatgagaatttcctgatggcgctggcgaccttcggcgcgtttggagtgggagagtattccgaggcggtggcggtgatgctgttctaccaggtgggcgaactgttccagagctacgcggtgaaccgctcccgccagtccatttcggatctgatggatatctgccccgagtacgccaacatcgaggaggacggcgtgctgcgccaggtggacccggacgatgttgaggtaggcgacgtgatcgtggtgaaggccggcgagcgaattccgctggatggcaaggtggtattcggcgattccatggtggacacctcggctctgaccggcgagccggtgccccgcagggcgtctgtgggcgacgaggtgatcagcggctgtgtgaacggcagcggacttctgcgggtggaggtcacccgggagtttgacgattccacggtggccaagattctggagctggtggagaacgccagcagcaagaaagccaaggtggagaatttcatcaccaagtttgcccgctattacacgcctgccgtggtgattggcgcggtgattctggctgtacttccgcccctgctgctggggcagtcctgggcggagggcgtgcgccgggcctgcaccttcctggtgatttcctgtccctgcgcgctggtgatctccgtgcctatgagctttttcggcggtatcggagcggcgtccaggaagggcgtgctggttaaggggagcaacttcctggaagcgctctccaatatgacgaccattgtgtttgacaagacggggactctgaccaggggcgagtttaaggtgacggagattctgcccgggtccatgggaaaagaggagcttttggagctgaccgcttatgcggagagctattcggaccatcccatttcccgctccattctggaggcctggggcagggagccggaccggagccgcgtgagagacaaccgggagatagccggtcacggcctggaagccgtggtggacggcaggactgtgctggcgggcaatgagaagctgatgatccaaaacggcgtggcctttgaggcctgctccagcgcgggcaccgtggtttatgtggcggtggacggcgtttacgcgggcgccgtggtgatctccgacaccatcaaggagtcggcggcggacgccatccgggagctgaagcgggtgggcgttcgaaagacggtgatgctcaccggcgaccggaaagaggtgggcgaggcggtggccgcccagctgggactggatgaggttcacgcccagcttttaccggaagataaggtggagcaggtggaacagttgttgacgcggcagagaaagggcgaaaagctggcctttgtgggcgacggaatcaacgacgcgccggtgctcagccgggcggatatcggaatcgccatgggcagcatgggctcggacgcagccatcgaggcggcggatgtggtgctgatggacgacgatcccagaaagatcgcctccgtggtgcggatttcccgcaaaacgctggtgatcgtgaagcagaatattgcgtttgcactgggagtcaaggccattgtgctggccatgggcgcgttcggtgcggccaatatgtgggaagcggtatttgcggacgtgggcgtgtcggtgatcgccattatcaacgctatgagggctttgaaggcggaataaggtaatcggcgtaaaaatatgccgggaagcggaaaacttcccggcatttgccgtttaatgcgtttaaagccggttcacagcgttacccggcgctgcgcgggtgggaatattctcagatgagaatatcttccagacaacgcttgggcacgtaatgcacctggtccttgtcgcggtaataggtggtggaaccgtcggcattcagcggggccagcaccacggtctccgcgggcttgcccagggccagcaccagatccagggaataggtctgggggtccaggtccagcgcttgtgccagttcgctgcggttaaagctgccgatcatgcagccgccgtagcccttctccaccgcgctgagcatgatggtctgggcggcgataccgtcgtcccactgcttgttcttgcccagggacaggtcgcaggcgatgatgatgtaagcgctggggcgctctccctcggcgggaccgtcccagtcggtcagggctccggcccacttgacggtggaaaataccttggcgcactctgcgggcgtgttgacgatcttgaatttcagagcctgggcgttggacgcgctggcggtcaggcgggtgttatccaccatgtcctccaggtcgcgggcggggatggatacctcctgatggaaccggcggtaggaacggcagttaagcaatagatcctttaacatgtgacagcctcctttcgggtctggggttggttattcttccggcagcagttccttgccggtcatgatgtgctgcttgatggcctcgaatgtggaggcgctgagaatatgctccatgcggcaggcgtcctccaccgcggtcttgcggtccacgcccaggtacatgagccagttggacagaagcgtgtggcgctcgtacatggtttcggcgatctcacgcccgctttccgacagtgtgatgtagccgctggggtccaccaggatgtagccgttctcacggagatttttcatggccacgctgacgctgggcttggagaattccagctctgtggcgatatcgatcgagcgcacatggggctttacctggctcaacatcagaatggtttccaaatagttttctgctgattcctgtatcttcaaagtccacctctccctcaaaacattaattgattaacctcaaatgggtattatgctctagtgtaacatattttctcggaaagttcaaatgccgggggcggggcggaaacaacttcgtgaggaattttcccgattgtcattgacaggacggccgtaaggtgctaatttaagtatagataaagttagaaataactaacctcaagagaaggagagagaacatatgacatttttgatggaaaatttatccacggttatcattgggctgattctggcgggagtggtgtatttggtggtccgcaagatgataagggacaggagagaggggaagggctgcggctgctcgggcggctgtgcgggctgcagcggcgcttccatgtgccatggcggacaaaggcctggaagggaaaagcaggtctgactccggaaatgccccttttcagatcatgtctgatatgttaagataaagggataacagacagactggacaggatgagagaatggactacattgttttggatctcgaatggaaccagagccccaacggaaaagaggactccgtggagcatcttccatttgaaatcatagaaatcggcgcggttaagctggatgaagggtttcgccagaagggcgagttccaccggctgatccggccgcaggtttacagacaactgcattttaagatatcggaagtcacccatatggatatgggggagctgaagcaccggggaaagaatttcaagcaggtgatgcgtgagtttttggactggtgcgggacagagtattgtttttgtacctggggctccatggatctgacggaattacagcgcaatatggactatttcaaggtgccgaacccatttccacggccgctgctctactacgatgtgcagaagctttactgcatggagtacggggacggaaagaacaagccgtcgctggatcaggcggtgcaggagcggggaatccgccaggagcggccgttccaccgggcgttgtccgacgccttttatacgggcagggtgctggcggtgatggatttcgagcaggtcaggccgtacatttccgtggactacttccggctgccccggaacaaagaggaggaggtatccctccggttccccgactatgccaagtatgtttcccggccctttgagaaccgggaggaggccatgaaggacaagacggtgaacgacatggtctgtccctactgcaaccgcatgctgcgcaagaaggtgcgctggtttccctgcggccagcggttctgctacggcctcgcggcctgcccggagcacggtcttatgcggggcaagctgcggatcaagaaagcggagtacgggggcacctatgtggttaagaccataaagtccgccacggaggaagaggcggagatgattatgcagaggaaggaagaggggcgcaggcggcgcagcgtccgaaaccatacgagaaatcagaagggcaaatcctgagaggctttggagggattttgagacaataaaaaggctgttccgtttacaggtcactgtgggcggaacagcctttttgacggttgcagggaaggggtgagcttattcctcgcgcatgcggtagcccacgccgatctcggtgtatatgtactgcggttcggccggatttgcctccagcttgcggcggatatgggccatgttcacgcgcaggatctgattgttgctgtccgcgtaggggccccagatttcgttgatgatgtagtcgtaggtcagcacccggccggcgttctgggccagcagggacaccagcttgtactcgatctgggtcagatgcacgtcctgatccttgacctttaccagacgccgctcaaaatcgatcatgagatcacccacatggtagaggggctgggatttagcggaagcgcccgtctggctgtggcgcagggccgtgcggatgcgggccatcagctccgaggtgccgaagggcttggtcaggtagtcgtccgcgccctgatccagggccgcgaccttgctcttctcctgcgttctggcggaaatcacgatgatgggcacggtgctccagaggcgcactctgcggattacctccaggccgtcgatatccggaagacccagatccagaaggaccacgctgggcttagtggacgcaatcagtgcaattccatcatttccgttggttgccgtggaggtaacgtatccgtgggcttccagaatagtctcaataaaactgcagatgttcttttcgtcctcgatgatgataattgtggatttaggctccatagtcttttctccaatctggtaatataaatgtgaattccgcgccgttttcatggtttcccgcggatatctgcccgttgtgggccgctacgatggtgcggcagatggacaggccgatgcccatgcccttgtgggcgtccgtgccggtaccgcgcttgagggttccgccctcaaacatggttcccaaaagctggggatcaatcccctttccgtgatctttgaccgtgaatgcggcgtctggcccattgagcgtcacggagagctcgatggggaggtcgctgccggcgtgatagtaggcgttttccagcagattgttgatgacctgttcgatgagcgtggcgtccatgggaatgacgatgaactcctcgggtacggtgacggtgaccaatgcatccggaaaccgcctgcggaaccgctggacggcctcggagaccacttcctccaccggctcctccgactttttcacgtgggccacgccgcgttcgtcctggatgcgggtgatggacagcaggttttctaccatgtgcagaagccagtccgcgtcggagtagatgttctgagccatttttctgcgctcggcgcaggagaggttttctccgtgctccatcagcgtgctgctggtgcccaggatggtggttaaaggcgtccgaagatcatgggagatcgcccgcagcagattggcgcgcatggtctccttctccgcttccatcagcatgtggtccttttcctggagcagctggttttgcttggcctcgtgtatggtcatactgctgacaagggtggagatcagggccattccgatgaaggtgatgggatacccggacagcgtgaagtccagcgtcatataggggaaggtgtaagcaaagttcacccagaaaacgccgtagagggatgccaggattcccacggtatagcagtttgtggcgcgtgcgataaatacaatcgccacaataaagatcagcgagatgttaatcacattgttgctgaagtgaaaaaacaccgtggagatcagggtcgccatggccaggatcatcgcagtgaccggcagctggcgtattacatgacaaatgtgagctcccagacggaagccttttggtgtggacatgaccgttcgctccattaaaatcggtatatacaaagccattatactctatcgaaagagcaagttcaatgataattacgacctccggaagggaaaacgcttccgcctgctccgttttgcgggcggcgtgtaggaggaggtggtggaggagcggtactgctccataatccgctcaaattccgcggttgagtagccgatatcctccaggcgttggattctgcgctgccgtctctgcagcgccatggcctcctgtcgcctgcgcacatagagcttgaccgccacgatgatggccgtgatcacggcaagggaggcggcaattcccagcacggccgcgaggttggagggaatcttgaagctggtggcggtgttgggtgagccgccgcccggtttgccgcctccgccgccggacgggatcagaccggaagcgccggagccgtggggggcgctcccagtgtttgaaccgtctggtacggggctggcgttgctgccgttagagccgtctgaggcggggctagcgttgttgccgttagagccgtccgccggctggcctccgttggtgttggtaccgtccgctggctggccgccgttgccgttggtaccgtccgcagccaggccgctaccgttgccattagagggatccgccgcctggctgccgctgtttccattcgatccgcccgccgtctgtccgccgccatcggtgccggaaccgtccgccgcctgcccgctgccgtccgtgcccccggctccgccgaggagcagataggagcggcccaccggctggtcgccgtaggtatagttgacctgggcgatggcgttggagggagcgttccggtctagggtgtaggagagatgtggcaccgcgtcggagaatccggcgctcttggggatcacgatccggctgtcctcatccagatccagggagatggtatcctttgccgtcattcccgcaatggtcatatcgttgtccagggaggtgtaggtggtctcaaattccgagattttgagggactggaaattcccgaacccgaagtccagcatggccttggtgtccgtgtaatgggtcaggtggccgttcagcacaacggcgatcagcgtcatatctccgcgtttggcgcaggtgaccagggtgttgcccgccagggacgtatatcctgtttttccgcagaacgctccgttatagtaggcggcatcgttgcggttccacattttgtgatggttggcgatgggatagccgtcgggaaatttctctgcaggagcgcgtttcatattggggaggcggtaagtgcgggaaccgcagatttctacaaaggttggattctggatggccgcctgggcgatctttgccatgtcgtgggcggtggtgtagtggttttcgtcgttgagtccgctgggattggcgaaatggcttccggtgcagcccaagctggcggcccgctggttcatcaggtccgcaaaggcctcacgggtgccgctgacgtgctccgcaagggcgttggcgctctcgttggccgaggccaataacagggcgtacaggcagtcgcgcacggtcagctgatctccctcgtcgatgccggcggagctgctgtccgcctccacgttgtaaaccgcatcgtgggagaaggtgacgatctcgtctaaatcgcaggattcaatcacgattaaagccgtcagtatcttggtgatactggcgggataatagggttgatccatattcttgccgtataaaacggttccggtgccggcctccatgacaatgccgccgtccgcctggattgtcacgccggacggccaggctggggccgcccaggcggtcatcggcacggcgcacagggcgaatgccaggcacagcgcaaataatcgcttcattatattcggttctcctgtccatgaaatcactgagagggggcggaaagagtcaccttatagtataaaagatttccgaacccaagtaaagataaaaaggtgttattttttccccctgccgcgcagcgacagaaacaggctgacgccgaagaggaccagcaccagcgctccgtacaggcccgcgatacgcgcggcggtgtccaggaaaaagccttcgggtacaatattgatcagcatgtccgtttccggattgagaatccacaggtcatttttaaagaagatgtggtggaaaacgacgaagtatttggagaagtctgtggatatgacggccgccagaatcgccaggatgccgaagaacaggccggtgcccaggcagagggcggggggcagcacgcggcggatctgcgcttttaagccgaacagaagcgccaggcaggcaacggcagccacaaggcacacgcggcgcaggaaaatagccccgaggaacaggtcgcgcacgtcctccatgtgcgcgatctcgcggtcgttgaagaactcgcgggtctcaccgcccatggtggtgaccacatgcaggtcggcgcggtcaccctttaagtaatccatcatttcgtcggtcacgtccagaagatcctccatggtcattggagggagatcgtgcaggacctgatattttgtgtactccttctcaaaatatccgggattccagtagaccacggcctgaattgaggttatgaacaggatccacatcaggcagaacgcgatgagaatccccagcagtctgtgtacaaatttcatatgaaaaaaggcctcctttgggggatgtactaaaaacatcctttattatagcccatcggaagccttttaacaagtaaagtcgttctacacgtatttttctttgatgcgcaggcgggtcagcgcccgggccagcgaggcctcggagtgggagtgctccacgatgctctgcttctggcggagctgctcttcggcccgctcctttgcctcctgggcgcgccggaggtcgatgtcctccggcagctcggcggtgtccaccagcatcttcacgcggttgttcataatctgtataaaaccgttgccaaccaccgcgtgcagccactggccgtccggcttctgaagccgcatctcaccagtggagatggcgatgatcatgttctcgtggtggggaagaacctccttttcgccgtctgccagcgggatgaccagggccttgcagtggtctgcgtaaaataccttgtcgcttgcggtaatgtttaggtaaaatgtgttcacaagcctcactccttatttggcggcgctctgttccagctccccggcctttttcacaacatcgtcgatggtgcccacgttgaagaacgcggcctcggggtactggtccatctggccgtctataatggccttaaagccgcggatcgtctccttgacgggcacgtagacgccgggcacgccggtaaagttctcagccacgtggaagggctgagacaggaaacgctggatctttctggcgcggtttacggtggttttgtcctcctcggacagttcctccatgcccaggatggcgatgatgtcctgaagctccttgtatttctggagaatctgctggacctggcgggctgtttcgtagtgctcctgccccaccacctcggcttccaggatacgggagttggattccagggggtccaccgccgggtagattccctgctccacgatcttacgggacagcaccgtagtggcgtccagatgggcgaaggtggtggccggggccgggtcggttaagtcgtcggcgggaacgtacaccgcctgcacgctggtgacggatccgtttttggtggaggtgatgcgctcctggagctggcccatctcggtggccagggtgggctggtaacccacggcggagggcatgcggcccaatagcgcggacacctcggaaccggcctggacgaaacggaagatgttgtcgatgaacagcagcacgttctgatgctcctcatcccggaaatactccgccatggtcagtccggtctcagccacgcgcatacgggaccccggcggctcgttcatctgaccgaataccagggccgttttctccagaactccggattccttcatctcggtccagaggtcgtttccctcgcgggagcgctcgcccacgccggtgaaaatggagtaaccgccgtgctcggtggcgatattgctgatcagctcctgaatgagtacggtcttgcccacgccggcgccgccgaacaggccgattttaccgcccttggcgtagggggctaacaggtcgatgaccttgattcccgtctccagcatttccaccaccggactctgatcctcgaaagccggcggttcgcggtggatctcccactgcggcgaatccgtcagggaatctccgccgtcgatggtttctcccagaacattgaacagacggcccagggtggcgtcgcccacgggcaccttgattcctgaacctgtggcaatgacttccatgccgcggtacaggccttcgctggaggccagcatgatgcagcggaccgtgtcgttgccgatatgctgggccacctccatcacacagcgctttccggcgttgtctacttcaagggcatcttttatgtccgggaggttgttatgttcaaacaatacatctaccacaggtcctaacacctgtacgatcttacctttattcataggtcgatgataacctccttgtggatgttgcgtgttcggccgccgtcgccggcagccgggttttgcggctatttcttgtttttctgggcccgggcgccgctgatcacctcggtgatctcctgggtgatggccgcctgtctggcgcggttgtaggcgatggacagctcggagagcatctttttggcgctgtccgtagccgtctgcatggccagcatgcgggaattctgctcgcaggagtaggattccaccaggctgccgtagataaagccggaacaatagatgggcacgatgctgttgatcaccgcatccgccgagggctttaagttgatctcttcaagcggtacgttggccggaacggagaagctcagccgctttaagggcagaagctgttccatctccgcctccattttcatggcgtttaccatgcgggtgtagatgatgtgcacctcgtccagcttgccggtcaggtagtagtccagaatcatctcgctgatgatgcgcgcccggctcatattggggttctgcaccgtgtagtggaactgttcctccacgggaatgccctttttggcgaaatactggcggcccagaacgcccaccacgaagagcaggggagtgcccggcttttccagctgttcctccaccagtttgaacacgttgtggttgtaggcgccggccagccctttgtcggcggagaccacgatgtagccgatcttgcggtcctcaggtttgatctgagggcgggcgtcgaaatagggattatccatctcggggatgtggcgcaggatacggctgatcatctgctgcagggagtagaagtacggttccgtgtccgtcagcgtttttctggccttttttaattttgaggaggagatggtatacatggcgttggtgattttcatggtgtcctgtatacttttcatccggctctgtatctctcgggtattggccatattctcacctactttttgcttttatactctgcggttacatccagaatcttctgggtcagctcgtcggtcagcgccttgttggcttcgatttcctgtccgatctcagggtgaacgcggtcgaagtattccagaaggccgttctggaagtccttgacagcacgcttgtcgatatccagaaattccttatgggtggccgcgcacagggtgatgaccttggcgtgaaggctcatggggtggtacaggggctgctttaacagctccatcaggccgtcgccgtaggtcagctgttccttggtagtggcgtccagatccgagctgaactgggtgaacacctgcatctcacggaactgggccagatcgattcggatgctgccggaggcctttttcatggccttagtctgggctgcgccgcccacgcgggatacggagaggccaacgtttacggcggggcgcattccggcgaagaacaggtcgctctccaggaagatctggccgtcggtgatggaaatgacgttggtcggaatgtaggcggacacgtcgcccgcctgggtctcgatgatgggcagggcggtaatggacccgccacccagctcgtcgctcaaacggctggagcgttccaacagtctggagtgcaggtagaacacgtcgccggggtatgcctcgcggcccggagagcgttccagcagcagggacagggcccggtaggccaccgcgtgcttggacaggtcgtcgtagacgatcagcacgtccttacccttgtacatgaagtattccgcaagggcggtgccggagtagggcgcgatgtactgcaggggcgccggctggctggcggtggacgacagcacgatggagtagtccatggcgtcgtatttctgaagggtggacacgattcccgctacggtggaggccttctggccgatggccacgtagatacagattacgtccttgcccttctgatttaaaatggtatccactgcgatggaggtctttccggtctgacggtccccgatgatcagctcgcgctgtccacggccgatggggaacatggagtcgatggaaagaattccggtctccagcggaacgcttacggacttacggtcaatgattccgggggcctcgttctcaatgggccggtagtcctcggaagcgatgggacctttcccgtcgatgggagctcctaaggggtcgatgacgcggccgatgaatgcctctcccacggggatgcccgctttctttttggtccgggtgaccttggtgccttcccggattccggtatcggagccgaacaggatgcagccgatttcatttttgcgcacatcctgaaccatgcccttgattccgttttcaaacagtacgatctcgccgtacatggcttgatccattccatatatggtggcgatgccgtcaccgacccagattacctgcccgacctcctggtcgccggtatccaggtcataattctcaatctcttctttcaggattgagatgatttcacttgagctgatggaacccacgcagttcacctccacatcaatttttgctgtaattgcttcaggcgccctttcaggctccagtcgctttccacatcgcctacccggatcacaaaaccgccgatcagggaagggtcatgccggatcgtccagcggacgtcggacttttggtatttgcggcaaaggcgggcggtcatctgttccagctgctcgccggtcggctggaccgcgcagcgaagctcggcccggagtatgccgtttttctcaaggcagaggccgcggtacgcttccagaatctcgccgatccggtccgcgtcctggttgtcgcagagctcctttagaaagttctgcatggccgggggaaagatccggacgatggccgcatgcttttcctttaaggaagttaccgggctggacaacacctgccgcaactgcggcgcctgggcgaacagcgcgtccgtctcgtccaccgcctcgccggggatggaaagctcatagagcgcggtggcgtaattaattgcggtttgattcatccgtcacacctgctttcgccagatattggtcgtagagctgcaaactctggccggcctccccgctctcgcttaagacctttgcggtggcggccatcacaaggcctgcgatctgcgtgcgggcttcctccagagtcttttcccgctcctgctcggcggcctttttcgcatcttccaggattctggccgccttgcggtccgcctcggccacgatccggtcgtattccgcccgggcgctggccctggactcctccacgatccggatggactcggcgtcggaggttttcagcttttcttcatagctggcttttaaatccccggccgcctgcttgtcgtttttggcatcggcgagctgctgctcaatcagagcggcccgctgttccataatggcggtgaccggcccgatcaaaaatttcttcaataacagacagagcacaatcaggttgacgattgtgatcaccatattccaatctaatcgcagcattcgtttcgcctgcctttcctgaaattattttaacagcataatgatcagaagggcgatgacgaaaccgtagatggcggtcgcctcggccaatgcgcagccaagtaacagcgctttgctgatcttgccctcggcctccggctgtctggcgatggcgtccactgccttggaggtggcgattccgattccgacccctgctccgattcctgtgagaactgcgatacctgctccgattgcgattaatgttgacatagtaagactctcctttttaatggtttagaattttttaatcttccagtgcttccttgataaacaaggcggttagaaatacaaatacatatgcctgtatcagcccgtcgaagatgtcgaagtaaaagctgaaggggatgggcacgatcagtgcgcatacctgcttgatcaattccataacgacgaaggaacccaggacattgccaaacaaccgcatacacagggaaagcggccggatgaaaatttccagtatgttgatcggtgcgatgatggggattggttcagcaaaacttttcagccatttcttcaggcctttttcgtgaaaaccggaatactcgattaaaagaatgctcataagtgatagtgcgactgttacattgagatcctttgtgggcggtttgaaaccgaacagcccgatgagattggcgacgcccacgtagagggcgaccgtaatcagataggggacatatcgtctgccgcgttttccgagtatcccatcgaagaactgataaaggaatccgatgcccatttccagcacaagctgtttacggcccacgtcggttaccttcaggttacggacgagacaaatggacaggatggtgaggattgccatgatgagccaggtcaccaccactgactcggatatgggaaggccgccgaaaacggggatggtaaacgccgttttgcagttcaactcttccagtagattctccgcgagatctcccgtagtgctcactccctttctgagatgaaattgaatgtaaaccacatgttacttctaaattttccgattgtcaaccgtttcattgtttgtaaccagatgcagggttgtggtcgaaaaatggagtaaaatgatgggaaaaatatacaatctactaaaaaaactatgcaaaatattgaaaaaagttcggccggttatgaagaaatgataaaaacagattggaaaattgtgaaaatagcactagaggggcgtaaggattttaacgaaaaattaacaaaactgtagcgtgaaggaagcgggggggagaggatcttttaaatgtaggagcgtctatctcatttttaagccaatctccgattcagatgtttcccacggaaccgttttgtcctgtctttccggttccctggtccgcatagcagcgccaattccgggagctggtaaagctgtccggaaacccaaaaaaagtccgaccccgcggcttccaatatccgcaaaatcagaccttttaagtgcgccttcagggactcaaaccctggacaaatagattaagagtttctttgcctattgatattttggggggagcggtgtaatataattacaggcaaggaattatgtaatttagttgtgcacaaagaacccccagggatggcagactctgggggcttcttgtccttaggctcgctgtgagtgagaaggcttttttggggtcttgacatttttttgggatcggggtaatataaatatagctaggaatgctaatgcaataacgtaatgatgcaaaacgaacccccagggagtgcagatctctgggggttcattttaggatcactgttactttttatttcggtcgatccatttacagatatagtagctaactatgcctgccataaccgaaatgaggaatgctaatatgtactgcgtaatgatgcacctccttcctgctgtgcagtctggagtataacagcgttttaattatacctgaattgtcaaaaaaggtctatcttattttttcatccaatcttcgattctgataatttccccttgaacatttctgccctggcttccaggcggccgagttcgcgcagttgctccggttccgtgagctggtggaagtaactcagtagttttttatctttattagttaattcttgattttcttttcctgttattaaccattctatagatattcaagattggagctgaaatttatgaggttgcaagaatgctttgaagatttttttagagacggcaacacgtactgggcgccatcctcttatcaatactataaacggaacgtcgactacttttttaactatctggcgaaccggtaccggcggccttccggttccatggagctgtcggagctgccggaaacaatccttgcggagtatgtggtttggctgcggccaaaggagaaatatgcgggccatccgctccggggtgcaatgaatgtaaacggtacgatcaaaaataatacagtcaacacttatatgtgcgcggtaaaatgcttttttaactatctgtatcgaaggaaatataccggaattcggtataccgagggcctaaagctgccgcggtcagatgatgaccagattgtttcgctgctggccagtgaagtataccggattgaccggatatttgacgaggagaagccaggggacctggtttttgacagcaatacgattgtcataaaccgcagcaaaggcaataaatcccgggtggtgctgatgtgtccgctgctggagaagctgctgcggcatacgtttgcaacatcctatatcatgggaggcggaaatcttgagacgctgcgcctgttgctgggacatttcgattactcggtaacacgcaagtatctgcacctggcggcacaataccagatcacaggcacagacatttaccggcttgatccgatattcttcaaaaaagggtactaatggtatctcaaaaaataatccgggcgcgcctgatcggcaccggcctgcgcgtccggaatttatttatgagatacaattatgtccggaaaccaaaaaaaagtccgaccccgcggcttccaatatccgcaaaatcagaccttttaagtgcgccttcagggactcgaaccctggacaaatagattaagagtctactgctctaccaactgagctaaaggcgcttgttcgtgcttggctgtgctgtgtttctcagcggcacgaacgttattatataactgaaaaataaaaaagtcaactatttttttgaaaaaattttatttttctttcagatgagcttcagaatccctttataaagccttgtttaaggctgcggacagctcgtttttggaggttacgcccacgaatttgtcggaaatctggccgttcttgaaaacgatcagggtggggatggacatcacgccgtagcggccggcaatgtcgctggcgtcgtccacgttcagcttgcccaccacggctttgccctcgtactcggaggccagggcttccacaacgggagccatcattttgcaggggccgcaccagtcggcgaagaagtccactaaaacgggcttgtcgctcttaagtgcctcgttgtcaaagttttcggatgtaaatttcatttccataatgtttggttcctttctcattttttatcgctttttttaactttaccgttgatgattttgtcgacttccttgaaagaacggtgaagccgaagtacctttttgtttaaatcggtcttgtcgctggtggcccttagcaggctccgcatcattttttccgggagcgccatcctgtccgcctcctggccgctatgtcttactgccaggatatgagccaatcgctgttagtgtgcgtggcctgatgaaaattatacaccggatgctgccgcgcggacggttcggacgcttatggctgcggcttccggcaggcggccagcttgcagatcggctggcctttggcggaaaattttatttcatattccgtcatcacgttgccttcggccatgtcggagtggtgaaggtcaaaggtgtgggctttcacggtccagccggctgcgggaatggattccagggaatagtcgaacaggccgcggttgtcggtcttgaattccaccgtgccctccgtggccagcacgctgtcgtaaaccgccataaattccggcgaggtgagacggcgcttggcgtggcggtcctttggccagggatcggagaaattcaaatagatccggttcacctcgccgggggcgaacacgtcccccagggtttttgcgtcaatgcacataaaaaagatattgtccagctccagctcggccctcttttgcaggccccggagcagcacgctggaatagcgctcgatgccgatgtaattgatcccggggtttttctgggccagttccataataaaacggcccttgcccataccgacttcgatctggatgggattggcgttgccgaacagcaggttccagcggcctttctgcgcctgcgggtcctgcacgacgtaggggcttgccgcaatcgtttcctcggcgccgggaatgtggcgtaatcgcatgtatttttcctctcaaagctacaatttttgcggaggtccgcaagctcattttatcatcgggcctatatatttgcaagaaaatttactttttccttaatattcagatttttactgaacaatttaaaaattataatgcaaaacctggggaaatttagtatactatacataatgagcggcttttcaggggcctgcataattttgtgattcggatttgtaacataaggtacaaaggagagaggaaaatggcaaatgtggagaacacaaccagctggaagcagatccagcagggcgtcagagagacggaacgcctgatcggacacaaggagtttaacctggcgatggtaaaggccaggcagactctggaatatatggtgcgctgcatggcggagaaagcctgcctggtggaaggagacttatccgacaccatcgaccagctttacgaaggcagatggatcagccgcaacaccaaggatcactaccacaacatccgcattttagggaataaagcggtgcacgagggggatgacacggcctacgatgcgaatcaggcataccagatgctggttcaggaggtcaaagccttcgccgacgagtacagttccggccgcccggccgcccggccttccgggtctggagcgcgcggcagccaggggcgcagttcctccgggaaccgccgtccggcccagcagcagggacgccgcccgtccggttccggcggcaaccgcaggaaaaaacgcaagagagtatccccagcctattatgtgctgaggtttttggtgccccttctggcggtcatcctgctgatcgttgtgattcgggcgctgttgccggacaaggaagataaggtgaaggagactaccgcgccggttaccgtagaagcgcccaccgagcctcccacccaggaacaggtgccggagcccactgagccgaccacacaggcggaggagacgggaggcgtttatgtgatcaccggcagcgccgtgaacgtgcgcaaggagccttcgaaggatgccaggattctggcccagctgaccaagggcgccacggtggattacgtcaagcgctactccaacgagtgggcggtgatcaactacgacggacaggaagcctacgtggccagccaatatctggaaaaacaggtgcccgccacagagggggagaacacgcccgcgacaagccaggcggctcaatagagaaaataaatattaaaaaaatataaactatttataaaaaatatataaaataacagggcggcagctcgggatcaaactccccgctgccgtcctttttttatatttatatataaatattgttaaaaaattaatttttataaaaatttaagctggtattttttttgaaaagtagtagaatgatatgagcttaaatacaagagaatagtctttagaaaagctatttttatatagcgataagaagggcttatcttaaatatagaagcgatcagatcaaagaacaaggaggagcgatatggatactgtgattgacaagctctctgagattgaggctgcggctcaggccattacggacgaggcgaacgtccgcaagaaggcgtttgcccaggagatggatcagaagaccaaagcgttcgacgctgagctggagcaggagacatccgccagaatccgcaaggtgcaggagtcaatggaagcggatatgaaccgtaagctggcccagcagaaggcggattcggacgccctggtccggcagatagcggaaaattatgagaaaaagcatgaaacgtatgcagaggctctttttaaggccatgataaaggagtgaggatatgggaagcctgattgcttacagtgggatcaccacgaaagtaaaggcgatggaacgatggcgtataagcgacagccagtttgaggagatggggctgctggagtccgttcccgaggcagtggagtacctgcgcaggtttccgccctatggggatatctttaacgggctggaggacggccagctgcaccggggagacatcgagcagcagctgaacctgtcacaataccgggattttgccaagctttataagtttgccaacttaaaacagcgcagattcctggatctttacttcatgcattatgagattggaatcatcaagacctgcctgcgaaacgcggcggggcaccgggaccagcggcaggacctgtccatgttccgggagttttttgacaagcattccagcctggatttaatccagctctcggaatcccagaatatggatcaattcgtcgcaaatctaaacggatcaccgtattacgggcccttaagccggctccagcagaagggaaagctcacacttccggaatgtgagaatacattggacatgatctacttccggaatatctggcgtatcaagaaaaagtatttgacgaaaggtgaacagaagattatcgcccagtgtttcggcacccggatggatgtattgaatctgcagtggatttaccggtccaagaagttctatcacctggctccggcggatatctacgcgattctgattcccataaacctgcacctgaccaaggaacagatcaaccgtatggttgaggcggaaagcgcggacgagtttctgacgctgttagaaaccacctggtataagcgcagccttccggctggcctcagggacgaaccggatttaaagtctgtggccgatgagatcaacgaccgcatctacctgctgaccagccgcagggaaccgtactccatcgccattctgaattcctacctctactttaaggagagggaaattgagcggattatcaccaccctggaaagcatccgctatggcgtaaaaataagttaaagggggtttacaagtgattgagaaaatgaagttcttgagcattaccggccccaaggcggatatcgaccgtgtggtcgacacctatctctcccggtatgagatccatctggagaacgccttgtcggaactgaaaacggtaagggacttgagaccttatattgagacgaatccgtataaggaggagcttttgaaggcccaggccatgatggagagctaccacgagctgcttcccggcggcagcgagcggcgggtttccctggagacggcccttgagaccgtccgcagcctggaccggaagctctccgaactcacggagcagaaaaatgagctgttgtcccagcgggcagcccttcaggactccatggataaggtggttccgttctccgggctgaattacgacgtcaggcggattctggggtttcagtatatcaagttccgctttggccgcatatcaagagagtattacgagaaattctccgcgtatgtttacgacaccatcgacaccatcctctttaagtgcaaggaggacgaccagtacatctggatcgtgtactttgtgccggaaaagctggaggacaagatcgacgcgatctacgcttccatgcattttgagcgaatgttcctgccggacgagtacgatggaacgcccacccaggcgggtcacaacctggaggatcagatccgggagctggaggcgaagatcctccaggtggatcaggatatcgtggctgccatcaacagccgcaaggacgacctgaccgcctcctaccagcggatcagcaccttttccaccaacttcgacgtgcgtaagctggcggcctgcaccaagcacgacgaccacaccttttatattctgtgcggctggatgacggagcaggatgccagaagcttccagaaagagattgagaacgacgacaataccttctgcatcattgaggacgaccacgcgaacattatgagcaagccgcccaccaagatgaagaacccagggctgtttaagccctttgaactctatgtggaaatgtacggtctgccgaactacaacgagatcgaccccaccattcttatcggtctgacctactccttcctgttcggcttcatgttcggggatgcgggccagggattgtgccttttaatcggcggattcctgctctaccggttcaagaaagtccgccttgcggggatcatctcctgctgcggcgtattctccaccatcttcggtctgctcttcggcagcgtgttcgggtttgaagatttgattccggccatgtggctgaggccctccgaggccatgaccaacctgccctttatcggcaagctgaacaccgtgttcgtggtggccgtcggcctgggaatgctgatcattctcatgtgcatggtgttaaatatcgtcaacagcctgcgctcccacgatacggagaaggtttactttgacaccaatggcgtggcgggcctggtattctacttcgccctggcctgcaccatcgtgctctacatgagcggaaaagcccttccggctaccgtgattctggtggtgatgttcgtggcgccgctggtggtgatgtttttcaaggagcctctcaccgccattgcggagaagaaggcggagaaaatcgagggcggcgtgggaatgttcattacccaggggttgttcgagctgttcgaggtgctgctgagctatttttccaacaccctgtcctttgtccgtgtgggcgcctttgcggtgagccacgcggccatgatgcaggtggtgctgatgctggcgggagccgaggccggaagccccaactgggcggtggttatcggcggaaacctgtttgtctgcggcatggagggcctgatcgtgggcattcaggtgctgcgtctggaatactatgagctgttcagccggttctaccggggcagcggccgggccttcaagccctacggcaaggctgcggagcagcagtagcgtttataaatcgtatctgttcagtaccttcacagatacaagcaaaaatccatttaaaatcgacttcgtcgatgggatttttgcccgcaggcttagattttcatacggtcagcgcagcaagtgcgcagacctgctgaacagttattataaatcaatatctagggaaagaggagaatgaatcatgagcgtaatcgtaaaaatcacattggttgtggcactgttgttaagtattgttatccccttcggagcctttgcggcgggggagaagaccaagggccgctataagaccgccctggccgtgaacctgtttctgttcttcggaaccatggtgttcgccggagcgatgatgttctccggaaatgcgtacgcggcggaggcagcctccggggccgcttcctccgcgggcatgggatatctctccgcggcgctctccaccggcctgtcctgtctgggcggcggaatcgccgtttccgcagctgcctccgcggctttgggagccatcagcgaggacagcaccattcttggtaaatcgttaatcttcgttggccttgccgaaggtgtttgcttgtatggtctgatcatttccttcatgatcttaggtaagctgtgatcctatgaaaatgtacctgatcagcgacaacgtggacacgctgaccggcatgcggctggccggcgtggagggcgcagtggtacatgagagggaggaactgaaagcgcagttggataaggtcctggccgacaaagagatcggtatcatcctgctgactgagaaattcggcagggaatttcccgagatcatcgacaacgtgaagctggagcggaagctgccgctgatcgtggagatcccggaccgacacggaaccggccgcaagccgaactttatcacttcttatgtaaacgaagccattggattaaaactgtaagaccatagaaagcaggtgaagagtttgacaacagaggagaaactgaagcattttcaggatatctgtatggaggacgccagggacagaagcgcaaagatgctggacgactacatggctgcccttgaaaaatccttcgaggagcacaccgctgatgccaaacggcgcgctgatatgcaggtggcgatggagactgaaaagctggagcgcgagatgaacaagcgcctttccatcgcacagctggatttgaagcgggaagtcagccataagcaggaagagctgaaggataaattatttgtggagctgaaggatcttttggagaacttcatggataccgccgactaccagcgccttttggaatgccaggtcaaggcggccaaggagtttgccggggacgcggagctgatcatttacatggacccctcggatcaggataagctccagcgcatcgccctgcaccacaacgccaccatcaaggtcagcgaatactcctttatgggcggcacgcgggcggtgatcccggccaaacatattctcatcgacaattccttcgagacaaaactgaaggaagcacgtcatgagttcaaatttgatttaggaggtaagtagagtggctaagacaggtgagatttacggcatcaacggacccgtcgtctccatcctgggcgatccgggatttcagatgaacgagatggttttcgttggtaaggaaaatctggtgggcgaagtcattggactgacctcggaaaagaccacgatccaggtgtatgaggagaccagcgggatcaagccgggggaggttgtgaccggaaccggcgcgccggtgtccgtcaccctggcgccgggtatcctgagcagtattttcgacggcatcgagcgcccgttgaacgagatcgccaagaccagcggccactatatcagccgcggcgtcagcgtggagagcctggatccggataaaaaatgggaaacccatatgacggtgaaaaagggtgaccgggtgttccccggctccatcatcgccgaggtcccggagaccagagccattacccacaaggtcatggttccgccggacatggaggggtatattctggaagtggttccggacggctcctacactatccttgaagagctggtgaccgtgcagctgatcgacggcacggagcggaagctgaccatgacccagaaatggcccatccgcgtgccccgtcccattgccaaacgttttccggccaccaagccgctgatcacagggcagcggattctggataccatgttccctctggcaaagggcggcacggcggcgattcccggcggtttcggcaccggcaagaccatgacccagcaccaaatcgccaagtggtccgacgcggatgtgatcatctacattggctgcggggagcggggcaacgagatgacccaggtgttggaggaattcacggagttgatcgaccccaagagcggcaacccgctgatggaccgcaccaccctgatcgccaacacctccaacatgccggtggccgcccgtgaggccagcctgtactccggtttgaccctggcggagtattaccgggacatgggctaccacgtggcaatcatggcggactccacctcccgctgggcggaggctctgcgcgagttgtccggccgtctggaggagatgcccgcggaggagggcttcccggcctatctggcctccaaactgtccgcgttctacgagcgggcgggtatggtgcagaacttaaatcagaccgaggggtccgtgaccatcatcggcgcagtgtccccccagggcggcgacttctcggagccggtgaccatgaataccaagcgtttcgtgcggtgtttctgggggctggacaaatccctggcctacgccagacatttcccggcgatccactggctgaccagctattcagagtatataaacgatttggcgccctggtacacggaccatgtgagcaagaagtttgtggattaccgcaaccgcctgatggctctcttaaaccaggagagcaacctgatggagattgtgaagctgatcggcgcggacgtgctgccggacgaccagaagctggtgctggagatcgccagggtgatccgccttggctttttacagcagaacgccttccacaaggacgacaccagcgtgcctatggaaaaacagtttaagatgatggaagtgattctctacctgtataagaagtccagggcgttggtgggtatgggtatgcccgtgtccgtgctccgggaggagaagattttcgaccggatcatctcgatcaaatacgacgtgcccaacgaccgcctggacatgttcgacgattatatgaagcagatcgaccagttctacgaccgggtcgtggagcagaacgcgtaaggaggacgaaaggatggcagttgaatatttaggtttaagtgaaatcaatggcccgctggtggtcctggaaggcgttcagggagctgcttacgacgaaatcgtggagatgaccgtgggaggaaatacccgcaagatcggccggattatcgagatttacggggataaggcaattattcaggtgttcgagggcaccgagggtatggcgctgcgcaacacccacacccggctcaccggtcatcccatggagatcgcggtgtccgaggagatgctggggcgcaccttcaacggcatcggcgaacccatcgacggtctgggggacatcatctccgacatcaagctggacgtgaacggcaagcccttaaacccggtgacccgggaataccccagaaactatatccgcaccggaatctcggcgatcgacggcctgactaccctgattcgtggacagaagctgcccattttctcgggcaacggactgccccacgaccagctggcggctcagatcgtgcagcaggcatccctcggggacaattccgacgagcagttcgccatcgtgttcggcgccatgggcgtcaaatacgacgtggcggatttcttccgccggacctttgaggagagcggcgtttccgagcacgtttccatgtttatcaacctggccaacgatcccgtggtggagcgtctgatcacccccaaggtggtgctgaccctggcggagtatctggcctttgagaagggcatgcacatcctggtaatcctgacggatatgacctcctacgccgaggccatgcgtgaggtctcctcctccaagggcgagattccgtcccgtaagggtttcccgggttacttgtacagcgacctggcctcgatctacgagagagcgggcatcgtggcgggccgggcgggcagcgtgacgcagattcccattctgaccatgcccaacgacgacattacccatcccatccccgacctgaccgggtacatcaccgagggacagatcgtgctggaccgccagatgcacggccagtccatctacccgcccatcaacgtgctgcccagcctgtcccgtctgatgaaggacggcatcggcgagggcttcacccgggtggaccaccaggacgtggccaaccagctgttttcctgctacgccaaggtgggggacgccagggcgttggcatcggtgatcggcgaggatgagctttcgcccatggacaaaaaatacctggaattcggcaaggcctttgaggagcagttcgtgggccaggacccccatgaaaaccggaacattctggagacactggagattggctggcggcttctgggaatgcttccaagggaggagctggaccggatcgacaccaagattctggaccagtattacaagcccaccgaagaggttcagtagcagcgtaaatggcgcgccctggcgcgccggatcaggcgggagcgcgggccggcacgccagggccgggcggcgttttccacacaaggagtgatgtaaatggatccgaatacatttcccacaaaaggcaatctgatgcgggcgaaaaactccctggtgctggccagacagggttatgggctgatggacaaaaagcggaatattctgatccgcgagctcatgggcctgatcgacgaggccaagggtatccagtcggagatcgactccaccttccgggccgcctacgcggctctgcagaaggccaacatcgagctgggaatcaactacgtccaggaggtgggggcctcggtgccggtggagaagggcgtgaagatcaaggcccgaagcatcatggggacggagattcccctggtgcagcacgaggcgaagccgctgcagctgacctatggattttacaatacaacccagtctctggacgaggcgcgctatcatttcgagcgggtgaaggagctgaccatcaagctgtccatggtggagaattccgcctatcggctggcaaacagcattaagaagacccaaaagcgcgccaacgccctgaaaaatattaccatccccaaatatgaaaccctgtccaaggacatttccgaggctctggaggagaaggagcgggaggagttcacccgcttaaaggtgatcaagcggaacaaggaaaagacgtgaggagaagcgatgcacacatttgacgatctgattggtatcatagccgagctgcgctcggaccacggctgcccctgggataaggagcagacctttgagagcctgaagaagtgcctggccgacgaggcacaggaggtctttgaggcggtggacaacaaggatatggaaaatctctgcgaggagctgggggacgtgctgctccaggtagtgctgtacagccagatcgcaaaggaggcgggcgccttcacgattgacgatgtgatcgacggaatcagcgagaaaatggtgcgcagacacccccacgtgtttggcgatatagaggtcaattcaccggaggaagcactggctctctggaaagagataaaattgcaggaaaaagccaaaaaaccttgacaaaacgtagagaaacggctataaatgattaagtacaccaagactcgtaagggtaaaaattccggcctttgtccggatcatattttaggaggaagaattgatgaacaagacagaattgatcgcagcagttgctgaaaaggcagagctttccaaaaaagatgcagagaaggctgtaaaggcatttacggacgtggtaacggaagaactggtaaagggcgagaaggttcagctggttggcttcggcaactttgaggtcagcgcaagagccgccagagtggccagaaatccgaagaccggcgagccgatgaacgttgaggcttccaagactccgaagttcaaagccggcaaggccttaaaggatgcggttaacaactaatccatgagactggacaagtttttgaaggtttcccgtctgatcaagcgcaggactgtcgccaacgaagcctgcgacgccggacgcgttcttgtgaacgacaagccggccaaggcttccctgaatgtcaagaccggggacgtgatcgagatccggttcggggaaaaggcggttcgggtagaggtgctggacgtgcaggagaccgttaagaaggacgaggcaaaagagctgtaccgttacctgtgatcgacattcattatgaataatggcatatattggccaacctcctaatatatttaacataggttagatatgttaggaggtttttgcatggaagaaaaactgaacggccgtctgcacaagctggtgttccagaaccggtctgcgggcagcatcaccggtattgcggacgtggtctcctttgatgagaacaccattgtgctggacacggacatggggcttttgaccattaagggaaaggaacttcatgtcagccgtctgaccctggagaagggggaggtggacgtggacggcaccatcgacagcatgacctattcctccaacgaggcgctgcgcaaatcaggggagtccctgttctcccgcctgttcaagtgacgggggcggtcttatgagcggggtgattcgctacgaagcgtggcttttgatgctgagcctggccaccggcgggtggctgatgctggtctacgacaccatccgggtgttccggctgatgatccgtcacaacgcctttgcggtgggacttgaggattttttttactggatcggggcgggggtagtgaccttcaatctcctgtaccagcagaacgacggagggctgcgcgcctatgtgatcggcggggttctgggcggtatgattttatatgaccgtttgatcagcagaattttttttaaaggcttgaaaaagctcggtaaaaagtttacaataaaatcaggtaaaaatacccggaacgtgacgggcaaagaacagacggaaaaagttggtgattgatcaggatgaaaacatatggaaaatctaggcgtcttcggcgggacaagtgggccaaccgtatggcgctgctcgggattacgctggtagtcgcatgtctggcggtcgtgatcaatgccaagggagccagtctccggcgtatggacctggagtacaaggtacgccaggagaacctgcaggcccaactggaagcggagagcaagcgcgccgaggagctggaggactacaaggtctacgtcaaaacgaaagaatatgcggaggaagtggccaaggagaagctgggcctggtgaatcctgatgaaattttgctcaaacccagcgaataatggaacttgatgattttccctgtcgaaagattttgtggacaggcctgcaaaatatgacagatatttccctcctgcctgcgtatactggacagtacgcggtgaggagggatttttgtgtttgaaaagaggaaagaaaaacgacgcgtttgcgatgtgaattattatacggcccggaggctgggagacatggcggattccctgggacggctggctaaggcatttgacgatgagattgaaagcggacggcagctgacaagagaggacggtctggcggccatgcagacctcgtcggccctggtttgcgacggctgcaccaaatgcagtctgcgcacggacacggagaaggaggacagctattacctgtattatcttctgcgggcttttgaacagaaaggccatatcgacaatgaggacatgccccagatgttccagtccggctgccggaaaaaggacaagtatttagggcagctgaaccgcaacctgggccgggccaccatgaatctgtcctggaagaaccggtttatggagagccgggacgcggtggtggtgcagtttcgtgagatgtccatgattttggaggaattttcccaccagatggaccaggccagggacgtgaccgaggattacgaggcggagctgcgcaaatttttcaggcgggctcacatagcggtacagaacctgctgatcctggagtatgagaacggccagagagaggcatacataaccgcgcgcaccaccaacgggcgctgcatgaccagccgggaggccgccggaatcgtgggacaggccatggaggacagcttctggagcccggccagggacagccggactatcatcacccgccagtacgccacggtgcgttttctggaggacggcagctaccacatgctgtgcggggccgccagaatccccaagcagggggagagcatcagcggggacaattacacctttgtggagagtcagggaagccaggtggtgatgagtctgtccgacggcatgggcagcggggagcaggcggaccgggagagccgccaggtggtggagctgacggagcagctggtggagacgggattttccgcccgctctgccttaaagctggtgaacacggtgctgcttctggcgggccgggaacagcatccggccaccctggatttgtgctgcgtggatctgcacaccggcgtgctggagtgtatgaagctgggagccgtgcccacctttatcatcggcgaggacggcgtggagcttctggaggcaggagaagtgcctatgggtgtgttgaccgcggtggagccggaactgatgagcaaaaagctgtgggacggcagccggatcatcatggtcagcgacggagtgctggacgctctgcccggggacgacaaggagcaggtgatgaaggaatatctggagagcgtggagaatatgccgccccaggagctggcggagcagattctggagtttgcgtcctcttttatcccggcggccagggacgatatgacggcgttggtggccggaatctggaaacggaggtaagggagccggggcgtccggcgcggtttcgcgggagggaagaacgcgccggactgcggcaaattagccgttgcaaactgccgggtttgcggttatagtagagtcatcagcaacaggcgacggcagaccgtgggggcttagggctcccgtaaacgttggctgcgggtgttttttggatatccggaaccggcgcgaggtgggaaaaaatggaatatgtacagcggaagtttctggaaaccattgaacaatatcatatgctgcggcagggcggccgggtggtcgcggccgtgtcaggaggggcagattccgtctgcctcttagcgttgttatgcggtctgcgcggggagctgggaatccaggtgcgggcggtccacgtgcaccatgggctgcggggggccgaggcggaccgggacgcggcgtttgtacggcagctgtgcgaaggttttaaggtgcccttcgcgctgcgccgggtggacgtgcgggagtttgcgcgggcaaagaagctgtccgaggaggaggccggaagactgctgcgctaccgggtgtttgaggagtgcgccggggcttgggagtgcggagcgtgggcggaatgggctggtgaaggcacgatatggccggaaggggccggggaggcggggggaggcaatgcgcggccgaaagcggactgggcggccgacggcgcccacggcgcggcgtccggcgattctccggagacggacggcgtcaggatcgcagtggcccaccacggcgacgaccaggcggagaccattctccacaacctttgccgcggcagcgggctaaagggcctgggcggtatgcgcccggtgaggggcaggatcatccggccgctgattgcggtgagccggaaggagattttagagtggcttgcggccaatggcctgtccttctgtcaggattccaccaacgacacggatcactatacccgcaaccgcatccgcagacagctgatccccatgctgcaggagcaggtgaatcccggcgcggtggagagcattctgcgcgtggggcgtttggccggccaggcggacgattacctgagcggtcaggcccgggaatggaccggacatcacgtgcgggaggagaacgggcgtattctggttcccggggaggcgtttgaacggctgccggagatcctgcgcgcctatgtgatttttcaggttatggcccaggtgggcggccgggcgaaggatctcacctccgggcatgtggaccaggtgatgggactgtttgggatgcaggccgggcgcagccaggatctgccctacgggatccgtgcggtccgggagtatgaaggggtggtgatcggccgccgggagacggctttcggacagccccggacagaggcggtttttcggtatttttcttataaaaaagggacagaaattcccaaaaaccagtatacgaaatggtttgactgtggtaaaataaagggtacgcccgtggtacggagccggcagtccggcgattatatcacgctggcggacggcaggacaaagacggtccggcgcttcatgatcgatgaaaagattcccagggagaagcgggactccgtgctgcttttggcggacgggagccatatcctgtggatcgtgggttatcggatcagtgaatattacaaagtcgggccggatacggtccgggtgatggaggtccgtatggaggccccggcccgggatgatccggccagtgatgtgataaaagaggatgaaaacggaggaaaagaccatggcagataagattcgggtgttgttgacggaagaggaagtggatacaaagatcaatgagatcgcagctaagatcagcgaggactatgccgggaagcagattcatctgatctgcattttaaagggaggcgtattctttacctgtgagctggcaaagcgcctgaccgttccggtttccatggactttatgtccgtatccagctacggcgcggggacggagtccagcggcgtggtaaagatcatcaaggatctggatgaaccgcttgagggcaaggatgtgctgattgtggaggatattatcgactccggacgtacgctttcctacctgatcgaggttttaaagcagcgcaagcccaacagcgtccacctgtgcaccctgctcgacaagccggagcgccgggtgaagaaacaggtgcacgtggattacacctgctttaccattccggacgaattcgtagtgggctatggcctggactatgaccagaagtaccggaatctgccctacatcggagtggtggagctgggctgaggacggccggatcagaccggcatcataacaatcgagggtttaaggaggcaattcgttgagacagcagtcgacatttagaggatttggatttgtgcttctgatgctcatcctgatcgccatggcggcgatgctgccccaccagggagcggcggataagatcacgcatcaggaattggtaacattactgtcggaggaccacgccgggatcgcgcaggtcaccatcaaccagaatccccaggtgcctacgggcgaggtgattatcaatatggcggatggcaccgagaagcagatgtatgttacggacgtgaatgaagtggagcagctgctgcggcagagcgggatcgacggctacaacgtgaccaacgtgccccaggagaatattctgctgaccgttgcccttcccattctgctctccaccgtggtggtggtgatcattatcatggtgatgaaccgcagcgccggaggcggcggggccaacgccaggatgatgaatttcggcaagagccgcgcgcggatgagccgggacaacaaggtgaatttcagcaatgtggccggactggaggaggagaaggaagagctggaggaagtggtggacttcctgcgcaacccccagaagtacaccagcgtcggcgccaggattcccaagggcctgctgctcgtgggaccgcccggaacgggcaagacgctgcttgccaaggcggtggccggggaggcgggcgtgccctttttctccatttccggttccgactttgtggagatgtttgtgggcgtgggcgcctcccgtgtccgcgatctgtttgaggaggcgaagaagaattcgccctgtatcgtgttcatcgacgagatcgacgcggttgccagacgcaggggcaccggaatgggcggcggccacgacgagcgggagcagacgttaaaccagctgctggtggagatggacggcttcggcgtgaacgagggaatcatcgtcatggcggccaccaaccgggtggatatcctggatcccgccatccttcgcccgggccgtttcgaccgaaaggtggcggtgggaaggccggatgtgagaggccgcgaggagattttaaaggtgcacgccaaggataagcctttgggcgaggacgtggacctgcgcagggtcgcgcagaccactgccggattcacgggcgcggacctggaaaacctgatgaacgaggcggcgatcctgtccgccagagagggacgccggtttatccgtcagtccgatatcgaccgggcctttgtgaaggtgggcatcggagctgagaagcgtagcaaggtgatcaccgagaaggataagcggatcacggcttaccacgaggcagggcacgccattctgttccacgtgctgcccgacgtggggccggttcacacggtttccatcatccccaccggcgtgggcgctgcgggctacaccatgccgctgccggagcgggatgagatgttcaacacccggggcaagatgctccagaacatcatggtggatctgggcgggcggatcgccgaggagctgatcttcgacgacattaccaccggcgcgtcccaggatattaagcaggcgacccagatcgcccgctccatggtgactcagtacggcatgtccgacaaggtgggtatgatccagtacggaagcgacgacgacgaggtgttcatcggccgcgacctggctcacaccaagagctatggcaacgggatggcggacaccattgacagcgaggtgaagcggatcatcgacgactgctatcagaaggcccgttccattatcaaggagtacgagtatgtgctgcactcctgcgccgggctgctgatcgagaaggaaaagatcggccaggatgagtttgaggcgctgtttaacgcgcccacggttactgcataaaaataaaacgcgcggctttgcctggtgcctgaaaagggcctgcaacgccgcggtttcatattttaaaagataaaagacatttgtttgtaacagttttttgagttggaagaaaatgggggataagtgtgctgtgtatcttgcatagaaaagaaaatcaaaaaaatgtatgtttgtgcacactttttccgaacctcatgctattataatacatgtaacccccccaatacattatatagtttttgctacaccccataagaaacgaaataccttctcctgaaaaacccggcccccccgccgggtttttcgttgaatgcaatgggccgctgacacagtctgtggacgattgctttcttagaaccgttcctacggtgggaccggcaaagaaacacgaagtcccttgactttctcgcctatcatgtgtaaaatggcataagcctttggcctttcaaacccggtccgaatctgcgaattcctgcatttttacgggaatctcacttgtatattaggccggattcatatacaataaaggtgtcaaatgctaatttatgaacatgaaaagggttttgggtagtggaagaatataataaaagaatgatcaaccgggaggctctcttctgttcggcgacggaagactaccgaaatcctcctgagccggatgaggaccaggacgtgctcctgcgtttccgaacgggaaaggacaatgcacagcatgtatattatgtggaggacggcgcggaggtagagatcgataaagcggattccgacgagctgtttgattattacgaatatgagataaccgtaggcagcgactgcgtactgtaccactttaaagttgtgaatggacaggattcctgtatttacaaccggctgggggtgacagatgatgacaggagctgctttgattttgccatcattccgggctttcacaccccggactgggccaagggcgcggtgatgtaccagatttttgtggaccggttttgcaacggggacgagagcaacgacgtccggacctgcgagtacgtgtacatcggcaggccggtgaaccgggtggaggactgggggaagaacccaaccaccatggatgtgggctgcttttacggcggcgacttaaagggtgtttggaaaaaactggattatattcaggggctgggagttgaggttatttatttaaatcccatttttgtgtccccctccaaccacaagtacgacattcaggattacgagcacatcgatccccatttcggggtgattgtggaggataaggacggtctggtggcggcggacgccgtggataacggaaacgctgaaaaatacgtggtccgcaccgcctccccgcggaatctggaggccagcgaccgcttcttcgcggaattcgtggaggagattcaccggcgtggaatgaaggtgattctggacggcgtgttcaaccactgcggttccttcaacaagtggctggacggcgaggagatttacgcccgccagggaggctacgagccgggggcgttcctgtccaaggacagtccctaccgcagcttcttccagttttacgacgagaaggacagcgcatggccgagaaacaagacctacgacggctggtggggccacgacacgcttcccaagctgaactacgagagttctcccatgctggtggagtatattttagacatcgcgcgccgctgggtgtccccgccctttaacgtggacggatggcggctggacgtggcggcggacctgggacacacggcggagtacaaccacgagttctggcgcaagttccgcgccgcggtgaagggggccaatcccgacgccctgattctggcggagcactacggcgatccgggtccctggctggaaggggaccagtgggacagcgtgatgaactacgatgcgtttatggagccacttacctggtttctgaccgggatggagaagcacagcgacagcttcagcggcgagcttctgggcaacggcgaaaactttttcaacgccatgcgctatcatatgagccgcatgcagccctcatccatcctgaccgccatgaacgagctctccaaccacgaccattcccggttcctcacccggaccaatggggtggtggggcggatcggcacggttggggccgacgcggcaaaccggggggtgaaggtctgcgtgctgcgggaggccgtgatggtgcagatgacatggcccggcgcgcccaccgtctattacggcgacgaggccggagtctgcggctggaccgacccggacagccgcaggacctatccctggggacatgaagatctggagctgatcgaatttcaccgttacatgatccgcatccacaaagcgctgcccgtgctgcgcagtggggcggtcaaggaactgctcgcggggcggaatgtgatcgcctacggccgcatgctggggaaatatcaggcggtggttgcagtcaacaacaacgcgcaggagcgggaactggagcttccggtgtggcagcttgggatcacaggggaaatatccctggcgcgcctgatgctcaccacggaggaaggctacaacgtgggcggcctgcgctacccggtccaaaacggcatgctgaagcttaagcttccggcgtacagcgcggcgctgtttgccacctatgcggatgagtttttcccggtggtcgcatcggtggagcccgtagaaccggcagcagagaaaaaatgagtcctgcacccctttgcattcaaaaaagccctgcggtttcagatgagctgatccgcagggcttttgccgtagtaaggctgttttattttgccgccttgacttctttccacatgtcgttgtagatggtctccacgtcgtctcccagatactggaaggtctcgctaccctttaaggagctgatgtccgggaacacagccttgttctcctgcaattccggatccagcaggtcgaaggcgcccttgttgggggtggggtaggtgatgtactcaaagttgcgctttgcgatgtccgggcggcacatgaagtcgatccatttttccgcgttttccttgttctccgcgttggcgggaatcacccaggaatccagccacaggttggtgccctcctcggggatcacgtattccagatcgtaatccagtcccagatccgccgcctgctcctggatgtagagcatctcgccggagtagatcacgcccacggcggcctcggcgttgatcattttgtcgcgcacctggtcgatcacgtaggcctgcaccaggggcttctgggcgatcagcaggtctctggcctcggccagctccgcctcgttggtgctgtttaaggagtatcccttgctctttaaagccaccatgaaagcgtcgcgcacactgttctgcatgaggatttccccgcttaagcgctcatcccacagatcagcccacttggtgggggcgggcacgcctaactcctccaggcgctgcttgttgtagaggatgcccacggtaccccagcagtagggcacggagtatttgttctccgggtcgaagtccttggacatttccatgtattccgggccgatctccttgacgttggggatgttgtcgaagttcagcggagccagcatgtcgttctggatcatgcgctggatcatgtaatcggagggacagaccacgtcgtacttcacgccccccgcctcgatgatgggaaacatctcctcgttggtctcgaacacgtcgtaaaccacgtcgattccggtctcctcctcgaacatggcctccacgtcctcgtcgatgtattcgccccagttgtacacgtagagcttgttgctctgcgcgtccgcgccggtctcggctgttttgtccgatttcccgcagccggccagcatagcggctgcggccagggcaatcagggcggtcagggtcattgttctcacagtcttttttctcataattgttctcctcttaaaaatgatgtgttataagtgatccccggccgttaatggtcatcgggtttctttgcggaacggaaattgacgatcagaagcaggatgagcacggtcagaaatatgacggtgcttagggcgtacatggaaggccgtattccgcgtctgacttcgctgtaaatcagggtggagagggtgttgatgcccgctccctttgtaaagtgggtgatgatgaaatcgtccagagacatggtgaaggccagcaggaagccggacagcacgccgggcatgatatccgggaacaccaccttgaaaaacgccctcaccggcgtggcgcccaggtccagggccgcctcataggtggtgcggtccgtctgtttgagcttgggcatgacgctcaggatcacataggggatgttgaaggtaatgtgggagatcagaaccgtctgaaatcccagggagatgccgaaggcgatgaacgccagcatcagggagatgcccgtgacgatgtccgcgttcagcatgggaatgttggtgatccccatgatcacggtgcggggaagcgcccgcatgttattgatggccacggaggccgcggtgccgatgatcgtggccgccagggcggacacaaatgcgatcagcagggtggtgtacagcgcgctcataatggggcggctgtcaaacatctgcacataccagtccagggtgaacccgccccactgggttctggacttggaacggttgaaggagaggaccatcatggtaaaaatcggggcgtataaaaagaccaggataatcaccatataaaaatcggaaatgattttccgcagtgtctgtgtgccttttgtcatcagaatgccgtcccctctccgtttttatcgtatttggcgatcatcgccatgctgatcagaataaataccatgagcaccagggacaggccgctgcccagatgccagttgctgcccttggtgaactcctgctcgatcacatttccgatcagcaggatcttgctgccgccgagcagatcggagatcacgaaggtggtcagcgagggcacgaaaaccatggtgatgccgctgatgatcccggggatgcttaagggcagccagatgaagagcagggtctggaagctgtttgcgcctaagtccttggcggcgttaatggtattgtcgtcgatcttggaaagcacattgtaaataggcaggaccatgaagggcaggaagttgtacaccatacccaggatgatggcccagggcgtgttgatcagggactgcttcggcaggtgaagccaggtcaggatcccgttgatcacgccgtttttttccaataacgtctgccaggccatggtgcgcagcaggaagttcatccacatgggcagcacgaaaatgaacacgataaagccgctggccgcctgtccgcgtccccggagaatcatggcaaggggataggctaaaagcaggcagatcagggtgctcaccagggacaggcccagggagagccacagggcgctggcgtggtccgccgaggcgatggccagcacgttctgtaaggtaaatgcgccggatttgtcggtgatgccgtaccagaaaatcagcgcaagggggatgagggtgaaacccaccatccagaacaggtaaggcccggacaacagctttttgcccagagccgcgcggttttcattattcattgactcccaacgcctcctcgtcctcagaagcaggcttattcatgatctgaatttcaaagggctccacatggatgcccacctgctgtccaaccgggaacatgtcggtggagtgcaccagccattcgaagccgtccggcgtggtcacctccatctcgtagtgcacccctttaaagatcaggtgggtcaccacgccctggagcgtgccgtcctcgggcttcaccaggtcgatgtcctcggggcggatcaccacgtctacgggtttgttgttgccgaagcccttgtccacgcagacgaagcgggctccgaagatttccaccagctcgtcgcggatcatggtgccgggcacgatgttgctctcgccgatgaaatcggccacaaaggcgttctccggttcgttgtagatctgttccggggaacccatctgctggatgtagccctggttcatgaccacgatggtgtcggacatggtcagcgcctcctcctggtcgtgggtgacgtagatgaaggtgatgcccagttcatttttcaggcggatcagctcgtactgcatatcctggcgcagctttaagtccagcgcgcccaggggttcgtccagtaagagcacccggggctcgtttacaatggcgcgggcgatggcgatccgctgctgctggcctccggacagggaggtgacgtcccgcttctcatagccgggcaggttcaccagcttcagcgcgtatttgatcttgtcgtcgatataggatttcggtttgtttttgattttcaggccaaaggcgatgttctccgcgatgttcatgtgggggaacagggcgtatttctggaacacggtgttgagctggcgcttgtggggcggcagcttggtgatgtcctggccgtcgaaaatcacgcgcccattgtccggcgtcacaaaaccgcccagaatccgcagggtggtggtcttgccgcagccgctggggcccagaagggttacaaagctgttctccttgatggagagatttaaatcatccaataccagttctccgtcaaagcttttggaaatgttttgtaaatcaatcaatggctggctcattgcattcttctccttatggtaaataaaattaaaagctggggggagaactcacccacaggataacggcgccgcctttgctggtcagatagtgttttttatccgccacaaagtagaaggattcccctttttttgccttatatgtcttggccccccggtgaatggaaacgcttccctggagcacatagccgaactcctcgccctcgtggggattgtccgggtaggtggaacctccggcctccagagtcaggagaatgggttccatcacatttttctgggcgttgggaatgatccacttgatttcattgtgcagctccgtgtcgatcttctcaaagtagtcctgtttgcagaaaacgatctgttcctcctgggtttcattgaaaaattctccgatggaggttcccaggcactgcagaatgtccatcagcgtggcgatggagggggaggttaagtcccgctccagctgggagatgaagcccttggagagctcggtgcggtccgccagctcctcctgggtcagcccttttagtatccgcagttcctttagtttcgcgccaatctgcatatggcacctcccgttcttttttcagagataatatccataaaagtataataaaaaacgcctggaagtttacaaatactaactgacgataaaaataactaaaaagtttagtaataataaacacatgcgaagctaattataccgcgttttacagttctgtcaatacctttttggaactttcggagggcctggcgcaaaatcataacagttccgacggttcatattccggaccgggcgcgcaaataccctaaaataggaataggaaacactttctggttaacaaaaactaaaaattatggtatgattgttttggtttttaaaaagcatcattctgggaggtaaaagcgcgatgaaaggtaaatatatggcatatgtagggtcctactcctacaccgggaaagcaaagggaatcacggtttttgatgtggacgtggaagcgggaacgttcaaggaacggtgtgaggtggaggtggacaactcctcctatgtgatcgcttccagcgacggaaagaccctctactccatcgcggacgagggcgtggtgtccttccgcattctggagaacggcagcctcgccaggctgaacagcgcctccatccgcggcatgagaggctgccatctgtgcacggacaaggaggacaagtatgtgtttgtctccggctatcacgacggcaagaccacggtgctcagcttaaacccggacggctcggtgggcaatattgtggacggcgtgttcgacaagggctacggcagcgttgcggagcgcaacttccgcccccatgtgacctgcaccaggagaaccccggacggccgctttgtcatgagcgtggacaacggcatcgaccaggtgagaatctaccgcttcaacgagcgggacaacaagctggtccaggtggacgcgatccgctgcgatctggagtcggctcccaggcatttccggttcagcaacgacggccgcttcatctatctgatgtacgagctgaaaaatgtcatcgatgtgttcacctacgagaccggcgaacggtccccggtgattgagaagattcagaccatttccaccaccagcaccctgaagccgggcaatctgaccgcagcctgcgccatgaggctgtccagggacggaaagtacatctactgctccaacgccggtgagaatacggtcagcatctacagcagggatgagcagaccgggcttctgaccatgatctgctgcctgcccatcagcggcaattaccccaaggacgttgcgatcttcccggacggacggcacctggcttccgtgaaccacgacagcggcaccctgaccttcttcagcgtggactacgaaaagggcctgctggtcatgagcggcagggctgtcgaggtcaacgagcccaactgctgcgccattgtaaagattggatgatccgctgcggacggatataaggactgggtgtaactgttcaggacatccgatgtggaaattggtacagaaagcagcttacaagcaagcttgacactgccttctgtaccaatttccacgccgtcctgaactgttacgccggaatattaagacatacaaggagtaagacatggcaggttcaacctacggaaccatatttaagattatgacctggggggagtcccacggaaccggcatcggcgtggtggtggacggctgcccggcggggctggagcttgacgaggcggatatccaggactggctggaccgcagaaagccggggcagagcaagtttaccacagcccggcaggagggcgaccgggtggagatcctctccggcgtattcgaggggaaaacaaccggaacgcccattgccctggaggtgcgcaacacggaccagcgctcccacgactacgggaatatcatggatgtgtaccgtccgggacacgcggactatacctttgaccggaagtacggattccgggactaccggggaggcgggcgctcctcgggccgtgagaccatcggccgcgtggcggcgggagccatcgcggccaaggtgctggagagtctgggcatccggattcaggcttataccaggtccatcggcccggtgtccatctctccggagcggttcgccccggaggaaatgtggaagaaccggctgtacatgccggatgcagaggccgccagggcggcggaggcttatctggaggagctgatggcccgccgggattccagcggaggcgtggtggagtgccgggtgacggggattcccgcgggcgtcggcgagccggtgtttgagaaactggacgccaatctggcaaaagccattctttccatcggagcggtgaagggctttgagatcggggacggctttgccgccgccgggtccaccggttcagtcaacaacgacgccttcggcctggagcgcggaacggtctgcaaacgcaccaaccactccggcgggaccctgggcggaatcagcgacggaagcgacctggtattccgggctgctttcaaacccaccccctccatcgcctcgccccagcagaccgtgaaccggtccggcgaagaggtggagattgagatacacggcaggcacgatcccattatcgtccccagggcggtggtggtggtggaagccatgacggcgctgacggtgtgcgacctgttgttggtgtccatgacgtcgcggctggaccgggtacaggcgttttttgaagatatgcgctgaggcagcggatataaaggggaaataaaatgaagaaggcgtttcctttttataattacaaattattgattcgaattttgagggggtgtcgcaaaatcatcaaaacagatgatggagcggcaccctcactctgtatggtttgatacgattcctcaagcttctctaaacgcttttggattcgtacagacgcttgcttcccttcgctatggtgcattttctttacaggggcggtcgtaccgaatcatcgtttggaaccatcccttccaatggatcaattctcataattaattatactgcggaaagcggactcttcggagcccgctttcctgttttttgaggcaaaaaaaggagctgctgctccagcagattatttatctacttttgcaatagccccttaaaattttggcgtaatagttggctctatgtttttttgtgcgggatttgctatggtcagattgtaaagagcttccccagttcaggctgcttcgtcctgactccgcagtggcgcagcgcgctccacagcgtggcctggtggctggtgatgaccgggaggcccagatccgtctccagtgcgccgacgaagtccagggtgtccaaagccatacagctaaggaagaacacgtcggccccttttaaatccatggccttggagtttcggtagagaaacggcttttccgcgtcgggaatccggcggcctggaacgccggacatgtccatgccggcaatattggtcacatgaattccattattttccaagaattgccgttctgcctcgttggtggcgtcgggatagggggtcagtacggccactgttttcgcctcaagggcccttaacgcttccatcacggccgtgctggtggtgaggcccggggagccgctggcgctttcgatccgcttgacgcactcctgatcccagcccattcccttgatgaagcttccggacgtgcagccgaatacaatcaaatccagattctgccccttgtatttcgccgctgtgctctccagctgatcggtgaggattaccaggccctcaggggtggggccggggaacggcattttcatggacgagaaggaaaccccttccggtgcatgaatatgaaacgcgtgctcgatgttttcgccgggcatgggactgattaacccgattcgtgccctccaaccatacatgattaccacatcctttctgtgtgcgatccggcgtgtgcggaatttgtaagatgttatcattatacggttttttcgatacgaaaacattgtgcatgggaacattataatgaaaggataggcggccggtcagtgtttgtttcaacatccgttatagtgaaaaactattatgccattaaaaatgaatatttcacatacagatgcccggttggtatagttataatatgcaaattgccaaaaaggaggatggatatgagtttgagaccgaccagggaagaaatgattaaaatggcggtggaaacacgaaaacaggtaacgtccgcggtagtctcccgggaggagatggaacgttatcccgcccgggttgcgcccatgaggataccggtcagggcgggggactcacaggcgtttcttgtaagcgcacagggcggtgaagaacaggttccgctggtgatcaatctgcacggaggcggatttatcaaacagcgcacggagaatgacgaactgttctgccggaagctggcgctggcaaccgggtgcaaaattctggatgtagattaccgcgtggcgccggagcatccgtttcccgcagggcttaatgaatgctatgacgtagcggtctgggcctggaagaatggggaacagctggggattgaccgggaaaagatcatactctgcggccacagtgcgggcgggaattttgtggtggggatcagcatgctgctccatgaaagcgggatttttaagccgctggggattatctcggagtacccgccgctggatttgtcggccgatccggcgcagaaggagcagcggggacgctcgattccggccgagcgtgccaggctctataatctgtactactgtgaggaggagctgcagaaacatccgctggcctcccctgttatggctggggaggagcagctgaaggattttcccagggcgctgtttatcacagccggagaggattctctgtgcaacgaggcggaggcatttgcgctcaaagcggcgcgggccggaaatgaggtgacggttaaacggtttgagaaggccggacacggttttacaatctaccgcatgccgggacatgaggaggcattgaaactgattgagcggtttatccaacatcttttaatagattgcaaatgaaaaaatacgagggggatttacaatgaatcaattaacgatctgtctggtgatctgtgtgctgacggttatcagctacgcctggggaaaattgaaaatgggcaccacagccctgctcagcatggttgcctttgtggtcacgggctgcattgagccaaaggcggcggtagccaatttttccaacacaaatgcggtgatgatgctgtccatgttcgtggtggcggcaggctttaaccgcactcagtttgtcaaaaaatgcgcctccagcgtaaaccacattgcgcgggggtctctgaccatggtgatgcttggctatgtgttgatcaccattattctgtgccagtttatccagagttctatggtggtgttcgggattatggctcccacccttgcggccagctgtgaggaattgaatatcaagccctcaaaggtcatgttcccgctggtgattgtgtgtatcgcaacgatttccgtactgcctctgggaagcggcgccactgtttttgcagagctgaacggatatttgcaggcgaatgagtatacagtgtacacggtgggcctgatggactcgatgaaggccaggcttccgatgctgatcgcggtggcggtctatgtgattttcttcgcggtgcgttttgcgccggatgaaccccaggcagctttgggtgaactcagggaaaagaaggttacaaagagcgtattgccgcccttccaggagaaggccggatacctcatttttatcctggtgacgctggggctgatttttcagaaggcccttggcctggatatctgggtgatcagcctgacgggagccgtgctcatggtggtgaccggcgttctctccgaacaggaggcggtggaggcggttccgtggtggatgggctttctgtttatcggctccctgaccatgggaggcgcgctgacagccacaggggccggggaagcggtgggaggcgtgctggccggcgccatcggaatgctgggaaacaagtacctgattgggctggtgtttttcatcgttccctttcttctcacccaggtgatgatgaaccgttccgtgatgacaatttttatccccattgcgatcctggcgtgcaagtccatggaagccaatcccgtggggatcattattttggtacagtgcgcatgcctgagttcttttatgacgcctatggccacgccggcggttcccatgtgtatggcggccggagggtatgatttaaaaagtctgatccgccagtcccttctgccggcagtgcttctctgcgccgtcaatgtaggatggatcatgaccgtgtttccaatgtgaatttctgtaaaaaagtgaggtaagagatggactattatgaggaagctttaaagatacacgagaaggcgggaggaaagctggagattgtcagcaaggtgccggtaaagaccagggacgatatgagccttgcctacactccgggcgtggcccggccctgcatggagatcagcaacgacgggagaacggcctaccggtatacggcgaaacggaatctggtggccgtggtgtccgacggaacagcggtgctgggactgggggacatcggcggacaggcttccatgccggtaatggagggaaaagcgatcctttttaagaacttcggcggcgtggacgcgtttccaatctgcctggacacaaaggatacggaagagatcattcagaccgtaaaaaatatcgcgcccaccttcggcggaattaatctggaagatatctgctcacccaagtgctttgagatcgaaaagcgcctggaggaggagctggatatcccggtctttcacgacgaccagcacggaacggcgattgtggtaaccgcggctctctacaacgccctcaaggtggtggacaaaaagattgaccaggtacgcgtggtgctgagcgggcccggggccgccgggaccgccattgtgaaaatgctttttgcggccggggtcaggcacatgattgtttgcgatgagaacggtatcctttacagaggaaaagaaggcctgaagggtcataaggtcatgctcagcgagaccaccaatgaggaaatgcgcaagggatggctggcggacgcggttgtgggagcggacgtattcgtgggggtgtccaaaccgggagttctgacgaaggaaatggtccggaccatggggcgcgatccgattgtgtttgccatggccaatccggttccggaaatcatgtatgacgaggcggtggaagccggtgtgaaggttatgggcaccgggcgctccgacttcccaaatcagatcaacaatgtgctggcctttccgggaatattccggggagcgctggatgccggcgcccgggatattaactatgagatgaaggtggcggcggccagcgccatcgctgagctggtggaaccggaaaaactgtgcccggagtatgtgatcccgtcggtatttgacgagcgcgtcgcgcctcacgtggcaaaaagggtggcggaagcggcggtgaggtccggtgcggtgagggagtaagcggaaaaaggggaggggcgggtatcatgttcccgcctgctcccttagaaacgccagcgtagcttcattataggcaggcagctgctcccactggtgcacatgtccgccgccccggcagaggtagagacggctgccggggattccctcgtacagctccatcgttttttccatggtcacgaacaggtcacagtccccggcggcaatgagcgccggggcttttattgcgtgcaatgggccgatggcgcagcctgcgggcgattgttttacccagatcctgggcggtgtcgtggcccaggcaggcgttgcactgggccttgtaggcgtagtggggcatgggataggggtaagccatatcctggcgctccgcggcgcagagctcctgctcccgggtattctggaagctctgggagatggtcatccactggttcatccgcttgaaggtcacagggtccagctgatcgatgccgctctttaaaaccccgatggcccgccggaagctggcgctgacgctggcaaaggtgctggtcagaatcagggagcgcccaggcccatgatcagaagcagcggttccccgcggccggtggccgtcacgtgaaagttcagtccgttgactgttatatatctctctcaatccgttcttccgtgggtcaatccctttcctttcgcggagtttttccgtcgtagagcttgcgcagcacggtgccgcaggtcggaagctcccgcctcatgcgctccagcaccggggtatagcccaggtccgtgatgggtagatcgatgcgtacattgtttaaggcgctcaggcacatgccttccagaatctcgaacccgtggcaggccgtgtcgatgttgcaggagtggaccgccgaatcatcctcgatccaccgggcgaactgggtatagtagggggtctggatgggcacctgctggtggttgcgccatcccgggtccttgccggtcaccaggcgtccgcccgtttccctggtgcaggcgccccagaagccgtcggtctccgcgtacatatagccgtcggcgccgtaaacagtcaggcggttgtcgctgctggaaaattccggcgggttgtgggcttcgctcaggtatccgcactcaatgtaggcccggacgccgttttccagctccatggtgccgaacaggtagtccggggccgggtgggaatcctccagggcggccggaccgtgtatgtgcccggctacccatttggcgcggtgtccgccgttgatccacagggtgtagtccacatagtgggtgccaagctgggagaaccaggcctgggtttccacgtggattttgcgtatttctccgatgaccccggcatcgattttctccttcatccgctggaactgggacaaatatttctgctggtggcagaccacggccttgatgccgttctcatggcacagacgcgccatctcccgggcctcctgcaaggattctgccatgggcttttccagagaaacagccttcacaccgtatttgatccccaaccggatcaggttcaggcgcatatccgggtaggtaacgaagacaaacacctccgggcgcacggtctttaacatctcctccgcatccaaaaaacggggaacctgctccagatgatattccgccgctacccggtccatggcggcctggtcgatatcgcagagtcccactatctcgtaataatcgggattctccaaaagcccatgaatgtggattttcccacgcacgccaagtcccatgacggcaactgtatgtctgctcatatgattttctcctttatattgattctgaaccctggaattgtttcatgtaaattccgtcctgcctcacaacgccgtccgaatccagggctgcgtcgggggattcgtcctccaccatgatccagccgccgtagccggtatcctccagatagcgcacgatggcggggtagtcggtgacgcctttgcccatgaccgtccacctgccctcgccgtcccggtccttgaaatgtacgtggcggactttgttccggctctccttcagaatctccagcgcatccatcccaccgtttacaatatgtccgatatccggcgcgtagccgatattcgtccgctccagcagatccagaaggaccttgtagtcctcccgggtacgaaacagggaattcggtgcggaattgggatgataacaggtgattatgcccacctcggccgcttggtttgccactgcgtccatacaggcgatcaggcagcgacgccgcgcctcaaggacatcgccgctgctccggggattggcgcccgcgtggtgggaaaccatcagacgggcaaatggaaaatgcttcagaaacgcgatggcccggtccgtgagcgcggcctcctcccgggtttgggagctgtgctcccagggttgatggagaaccagggcggcgaactccatgtgatgcagcgttagcagctcccgtacctcctccggccggtcgaagtaggggccgagcatgcagatttccgcttccagcccctggaaaccggcggccgccgcagtttcaatgatgtgtggcatttggcctgcgtaggcttcctggttcattttccagggataggtctgacacccggtttgccgtacagggccctgtgcacagtggctccggaaacgcctaccgctttggagatggtgctgatagtaatatgtccctccatatggattctccctgcaaaaatctggtgtaattgatttcgaccatattataacaacaaccgggggtgtggtcaataaaaattgtgtattttgcattaaatatgtggtaaatatctgtatttttactacttttattatataaaatgcactatggcaaagtgcgtgaaatgtagcaaaaatttgtacaaaacaaaaaacaacataccaatttgtatgaaacggacattaaaggtatgatgaatttatgggatgattgcgcgaataatatacaaaagacacgataaaacaacttaaaacacagcttaaattaaaaaaatagttaaaaagctatttacaaacatcatatgttatggtagtataaggacagatgaaatgaaaatgtacacaataatcacttacaattaccgactggaaactaacaaaatgacggcggggttcacgcgggaagggggatccgatgcgcaaagatttgaaagaatttcagaatattgatgtgcttccgatggccacggcccagaaggtcaagaccatgatcatccagcgccagatgaagccgggagacaggcttccgacggagaaggagctggcagatctgttcggggtgagccgttccacgctgcgggaggcgatgaagttcctgagagcggagaacgtggttgtgatccgccagggaagcggaacctttgtcagcgcgggaaccggaatcggggaggacccgctggggctgcatttcaccaatcaggagaatctgattgagaacctgtttgagacgcgtatgctgatcgaaccgcagatcgccgggctggcctgtcatagggcgacgccccaggatatcaagaacctggagcggctggtggcggagatggaacgctgcgaggtgaacagcaaggtcacggcggagctggacgcccagttccacaccggagtggcggagtgtacgcacaatgaagtcctgatccgggtggtgccgatcattatcgaatccatccgaaggagtcatgtggagacgcacgacgatctggagagctttaaacgggccaagcgcagccacatgggaatctgtaaagctattgccgcaggagacttcgtggaagctaagtttcaggccgagcggcatgtgtgggaaacattaaatgatgtaagagaaatggaggaacgaaaatgaaaaaaagactgtttgcaaagaaaacgctggcgatgaccatggcggctctgatggctgcggggatgctggcgggctgctcctcaggcagcaaggagactaccgcggccccggccggcgacaccaccgcagctgcggctgacacaacagcagcgggtggggacgcagctgcggcggagggaaccggagagccggttaccatcaagttccgctactgggcggacaacacggactattccgctctgatgcaggagatcattgcgaagttcaacgctgagaacggcaagggaatcaccgttgtgggcgaggagagcccctgggacggcggcgcctactccgagaacctgttcaacgccaagatgggcggcggcgacgtggactgcgcaacctggaagctgacttccactcccctgtttgtgaacaacgacctgctggccgatctgacccccatgatcgacggctgggacaaaaaggacgacatcgacgagaacatttacgatatcatgaagcaggccggcggcagcgacagtatctatgtgatgccctggaacattcaggtactgtatgtatactacagaccgtccatttttgaggcggccggcgtggaggttcccaagacctacgaggagttcctcaccgccatcgagaagtgcaccatggataccgacggcgacggcaagaccgacgtttacggcttcggtatgagaggcgccaagggcggacaggagccgtggggcagctttgtatacggccgcggcggcagcttcgaggatatgaccaccccggaagccgttcagggcatgcaggatttcatcgacatctacaccaagggttacgtgccgccgacggcgaccagcgacggcttcaacgagattatcgccaactttaagtccggcttaaccgccatgacgatccatcacaccggttcctccgccgacatggaagcgaccttcggcgacgacgtgtccgcgttcccgttcccggcaggcaagggccagtggacctccatgggcgacaccgagaccgttatcttcgagtcctgccagaacaaggaagccgcctttgagtgggtatcctacctggcggcgggcgaaggccagaagatgtggtgcgagggcaccggcaacgttccggtcagcaagaccgtgcaggcgggcgacttcttccagagcaaccgtttcatgaaggcatccatcgacggacagagctatgcgggcatcctgcccatcctggacaccacaaccgagtggatttccaccctgtggcccaacaccgtatcccaggccctgaccggcagcatcaccgccgagcagtgcatgaagacccttcaggagggattgtaccgataaccgtaactaaccgatggggttgcagcgaaaactgcagccccataaatcagaagggggagttgatcaatggtcaagaaacgatccatatggccatacctgctggttgctccggcagttctcatcatcttatgcgtggtgttcataccggtcatcaacgctatttccatgagtttccaaaattacgacctgcgcagaccgaaggagattgcatttaacggagttgccaactacgccaaggccttcggagacccattgttctggggagcgctctggagaaccatcgtgtgggtggtggcaggcgttggttttcagtttctgttcggattcattctcgcccttctgctgaaccagaagttcgtggggcgcggaatggtgcgcgcggtgagcatgattccctgggtgaccccgggcgtgctgatcggcctgatgtggcgctggatttacgacggcaacttcggcgtgctgaacgacctgctgttaaagattcacgccatcggggataagattccgttcctgtcccaggtgggaaccgcgttcccaagcgtgatcgtgaccatcgtctggcagggcattccgttctttgcactcatgctgctggcggctttacagggcgtttccacggaaatgtacgaggcggccgacatcgacggcgcgacggcctggcagaagctgatctatgtgacgcttccgtccatcaagaacacgattttcgtcaccggcctgctgcgggtgatctgggtggccaactccgtggatgtgatcttcaacatgacggagggcggaccggcctactccacacagaccttgagcgtttacattttcaacaagggcaacgcgctggatctgggatacgcttcggctatggcgcttctgatggcggcgctgctgctggtggtggccattccatatctgaaaatgaatttccgggaagaggggtgagaacatgaaaaaacaatccaatgtaaaacgctttttcatcgtattccttccgctgattctgctgatggtatttatcctgttcccgttctactggacctttgtgacctctgtgaagccccaggatgagctttacggggcggtggttacatactggcccagccatgtgacctttgaggcctacagtaagttgtttaccaccacggtgaatttcctggcggccatgaagaacagctttatcgtggccagctttaccaccatcgtatcgctgacggcctccactttggcggcctacgcattttccagataccagttcgcgggaagaaagcttctcatgtgcaccttcctgtgcaacaacatgttcccgacggtgctgctgctgattccgctgtacaccatcatgcgcaagctgggactgctgtacacccccacctctctggtactgtcctacaccacctttaccattccgttctccgtgtggctgcttttgggcttcttaaacgacctgcccatgtccctggaggaggcggccttggtggacggctgcaacagaggctccgcgtttgtgaagatcattcttcccattttgggcccctgcctggtggcaaccggagtttacatcttcatgacatcctggaacgaatatacctttgcgatgatgtttaccaacaccgacacccgcaccattccggtggctctaaagagcctgattggccagctgggcgttcagtgggatctgctgaccgcgggcggcattatcaccatcattccggtttgtatcatgttcttcttcgcgcagaagcggctggtcgagggcctgaccgcaggcgctgtgaagggttaatcaatcaatctttcagccatcccaccacaaggtgagttgacgtcgataaatgaggaggaaaacaattatgcagtatgataagaaagcaaaagagttgcgggcagagatcctgaagatgctctacgcctgccagtccggtcatcccggcgggtcactttcctgcgtggaaatgctgatggcgctgtactacgaggtgatgaaggtggatccgaagaaccccaaggatccggaccgcgaccgcttcgtgctgagcaaaggccatgcctgccccaccctgtacgcgatcctggccgacttaggcttcttcccgaaggaagacctggccaatctgcgccagattgacagccatttgcagggccacccggactgcaccaagaccccgggcgtggacatgaacaccggttccctgggacagggcgcttccctggcaatgggtctggctctggccgcaaagcatgcgaaggcggagtacaaggtatacgcggttctgggcgacggcgagtgccaggaaggtctggtatgggaggcggccatggctgcggctcactacaagctggataacctgacctttatgctggattacaataaattgcagatcgacggaagcaacgacgaggttatgagccttggaaatattgtgaagaagttcgacgccttcggtttcgagtgcttcgaggtggacggccacgacatggacgccatcgtggcggcgctcaaggtccccgtgtccggaaagccgaaattcatctgctgtaacaccgtcaaaggcaagggcgtttccttcatggaagaccagttcggatggcacggcagccccatgaacaaagaacagtttgagaaggcgttaagcgagcaggaggtggagtaaatgggaaagtcattgagagttgcttatggtgaggcgctggtaaaattaggcgctaaaaatgataaagtagtggtgctggacgccgacctggcccatgccacccagacctgtatgttcaaggatgtgtatccggaccgtcatttcaacatgggaatcgcggaggccaacatgatgtgcgcggccgcgggttttgcccacaccggttacgttccctttgtgagcaccttcgccctgttcggcgcgggccgtgcgtttgagcagatccgcaattccatctgctataccaactgcaacgtgaaattcgggttctcccactccggcctgtgcgtgggcgaggacggcggaagccaccagtccatcgaggacatcgcgctgatgagagagctgccccacatgacgatcttcgttccctgcgatcccgccgagaccgagaaggccgtgatggccgccgctgagatcgacggaccggtttacatccgcgtggccagacctgtgtgcgacgacatcaccacggcggacaccccattcatccccggcaaggccaacgtgatgaaggaaggcacggacgtgtgcatcatcgcctgcggactgatgattcccaaggcgctggaagctgccgcgcagctggagaaagagggcgtgagcgccgcggttgtgaacatgcacaccatcaaacccatcgacaaagacattgtgctgaaaatgaacgagacctgcaaggccatcgtgaccgttgaggagcactccgtgatcggcggacttggctccgcggtggcagaggttctggcgggccacgacggcgcgaaattcgccatggtgggtattcaggataagttcggcaagtccggtaagccggatcagttgttcgaggcatacggcctgaccgccgccaacgtggccgccaaggcaaaagagctgctcaaataaatcaggaatcatttcggaggacgaggcaatgaacattttaaattacgagtttaacggcgagggaatgcagcgcgtatttgagaacgagaaatggacggtcggcatcaagaactggaaaccggccaacgacgtgaccggcatcgactgcctggagcgccacaacaagaccgacgagctgtttgtgctggtggaaggctcctgcaccctggtgtacgccaacgaaacagagggcggactggagttcggcgctgtgaagatggagaaggacaaggtctacaacatcccggccaccttatggcacaacaccatcacctgcaaggacaccaagatgattctgatcgaggattccaacacatccatggaaaacagcgatattctgaacctgaccgaggcgcagatcgctgagatgagaagcctggcataacaaagacggccggcggcggctgggaatggcctcgccggcctcccatatgaggaggaagaaaatgaaattttttgttgatacagcgaacgttgaggagatcaagaaggccaacgacatgggaatcatctgcggcgttaccaccaacccgtccctgatcgccaaggagggccgcgacttcgcggaggtgattaaggagatcaccgacatcgtggacggccccatcagcggcgaggtgaaggccaccaccgtggacgccgagggtatgatcgccgagggccgtgagatcgccaagatccaccccaacatggttgtgaagatccctatgaccgtggaaggcttaaaggccgtgaaggttctgaacgctgagggcgtgaaaactaacgtgacactggtgttctccgcagcccaggcgctgctggcggcccgcgcgggagcttcctacgtgtccccgttcctgggccgtctggacgacatctccatgcccggaatcgacctgatctacgagatcaccgagattttccagatgcacgatattgagacggagatcatcgccgccagcatccgcaatccgatccacgtaattgactgtgcaaaggcgggagccgatatcgccaccgttccctacaaggtgttggagcagatgacgaagcatcccctgaccgaccagggaattgctaagtttcaggcggattacaaggctgtatttggtgaataatgcgattgaaaaaatacttaagattcattataatgttagcagtgtaaaagctgctaacattatttttttttgaatgcaatgggccgctggcgcagcctgcgggcgattgttgggacgtaatgaccgccggaggcggtttaaaatggaggatgacatcgatgattaaaaaatttttggagtgcaccacagtcagagcgcggattgacatgctttccaacacctttttgggcgactggtccgagcaggacttaaacattattctgagcgccctgggcttcacggcggatgattacgcggccaaggctgataaaatttctgccattgagcaatatcttgcggactataagcgcaaggtggagcgggagaacaccatgaactgtgaagcgatggacaaaatgccggtccgggatgaaggggagaccatctaccgggaaaagggatttgccggtgttctgaagaatgcgctggaaaaggattgatttagggatcgtttgagggatgaagagccgtctgccgcggaatgcgggggacggctcttttaattttcctgttttagctcacatccggctgccccagcgcctgattcaccagcatgcgcagccttccgccgggagattttatgcagcccgccagaacgtcctcctccgtaaaacgcgccataagaatttcccgctgtttgacgcgctcgtagtcgtaggtcacgtagatatagccgtccgccccttccttcgcgtccgggtaggcggcgtcgttgcgttcgtccagcaacagcgtgtaaggccaggtctgtccgtcgtcttcgctgagcatggcggtcagatggctgcggcccttccagcttttcacgttaccctgctgcaggatattgttcagatcgatgcgctctccgaagtggaaatggttgatcatcagcaagcggccggatttcaggcggcggatgtggaagcgggaacaggggccgtcaatatggcttttgcggccaggagtccaggtgcgcccgccgtcgtgggagaaactctccccgattccgtcaaaggttcgcaccagcatccaaagggttccgtctttcttttccacgatcatgtgttcgtcgaagcttcggccaggtacgtcggcgctgccgcgcagcgaaaaagtttcaccgccgtccgtggaagcgtaaacgttggaaaactgttcctgttccaggccgtggcgctcagttgggggagcgccgcactcgtcccgccagatggcgcacgggaacaaccagtcgccggaggcgtccacaatgggcttgttgatcatgatgccgttggcaatccggcggggcggcgtccactccagccgcggtgcatccggcgctttgcagactgtggcccagacgccgctgcggcagtcattgaaccccttcgtctggttatagatcatccacagctcaccggcaggcgatatccacaggcaggggtcgtaaatacggcagagagggtccggatgttcaataacggtgacacaggagcgaaaggtttctccgcggttgtcgctggtacacagcattaggaaatttccgccgacctctgcgccctggcctgagaagaaatttacaaaaatacgccctttttctgtgacttcgatggagggaatgccctgccatcttcggtaatcgtcctgaaaacggggagcgtcgggctctacatataggatagccggtgtcatagaagaattgggatcgctcataagaacctccttttgactaatcattaatggtgagtgattagagcttatcatgaaacagagtgattgtcaataatattcaaaaaatggagaaaatgaagggattagttggcttattattggacattaatagaaaatacatcggctcatttagataaagtaaataaaactatggagtggtgcggagctgaaatggcaaaaaatacttgacaaacataagggtcaaagctatgattattctgtaactactcataaatgatgagcaatatgcgaggaataaacgaggagggaatgtatggcgcaacgtatcgtggatttgacactgcgtattgagaacaatatgctggcgcccgactgtttccagcgcccggtttatgtaaaggcgatgacccatgaacagtcggttgcaatggggaacgggaccaaggaggatccaatcacttcttcctataattatctttcaatcatcgaacatgtgggaacccatgtggattcgttctaccatatgaggccggacgggctgaccattgatcggatgccgctttccatgtttttcggcaaggcggtctgcctggatatgacccacatcccggagcggggaacggtgaccgtggcggatgtagagcgggctgaacgggagaacggggttgagatcgacgggcacatcgtcctgttcgcaaccggacttcatgagcgctactacccggatcccagggtccttacccagaacgtggagatatccccggaggtggtgcggtggctggcggcgcgaggctcgaaggtccacggcgtcgagggaccgtccacggatattatggataccaaattgtttcccagccacagggcctgccgggatgcggggctgacccactatgagtggctggtgaatctgacggctctgatcggggcgggtgaatttatgttttacggggttccgctgctgctggatcagggaacgggatctccggtgcgggccttcgccgtgttggaagattaaaaggagacgctatggccgaatatacattactgccgcagcgggaaaatcttcacggagttctggatccggcgctcccgccggcactccgtgtccggtccggggatacggttcatgtgaccaccctggaggcggactggaggcttggcagaccccagggatcgcctcctaaggcgccgctgtttccaagaatcaagggcagggacgacgggcatgcgctgtgcggtcccatctatgtggagggcgcacagcccggcatggcgctgaaggttgaaatcggtgagatcgtcacggagaactggggctggagctccgttggaatcggaaaccgggatcacttaaaccggctggggtttcacggggaggaggatttcagagtatgggatctggatgcccaccggggaatttgccaggggccggatggcatgacggttccgctttctccttttccgggcgttgtggccgtggcgccggagggggagcgcccggttcggacccacatacctggaaaccatggcgggaatctggactgccgcgccctgacctccggaagcactgtgtatctgccggtgttccaaccgggcgctttgttttccgtgggagacggccacggggcgcagggggacggggagtccggcggaacggctgtggaatgtccgtttcggagcatttccctgcgtctgtccgctgcggattacttgattaaaagcccggtggcgcatacggcggagggctggatgacatttgggtttcacgaggatctgactgtggcggcttacgaggcgctgcagaatatgcgcctgcttctaaaacgggcgtttgatatggaagaaacggacgcaatgacgttttgcagcgtcggagccgatctgcgggtaacgcagattgttaacgggatacgcggggttcacgcggttgtgccggaacggatctgggatacgctggggaaatgaccggccccactgaaccgggagaatggggctgcgggctgcttacgggtacattagcaaaagaattcagtatggaggtacgataaatggcgactttaatcatcggcggaaacggtctggtaggaacgaggctggtgtctcatctgtgcggcatgggggaggaagtgatcagcttcagcggacataagccatcctgtgaggtgaggggctgcacctatgtgcagggcgacgtgacggagtacgggacgatcaaccagattctgcatacccacaaggtggagcggatcctgcacaacgcggcggtctcccatccaaagctgtttctggacaacccctacaagatataccgaaccaatgtggttggaacgctgaccgctctggaagcggcgcgcaactacggcgtcagccgttttgtgtacatgagttccggcgcggtttacgggagcgtgtccctggagacggtgcctgaggagacgccgctgcattcggaaagcccctacggcgcaacaaaggtggcctgcgaggagctggtcaggaattacgggctggacagcgtgtccttgcggatcggctttgtgtacgggccgggaagaaagttcgagtgccccatccatatgttgttagatgactgtatgaaccgcaaagaggtgtgctgggagcatggcatggatcaggtcatggactatatatttgtggacgattgcgtggaggcgatagccactgtctctatggcaaaggaacttccccacagagagtacaatgtgggaggcggggagaatgtgccctattccagagtggtggagcaggtgaaaacgctttatccccaggttcccattcagatcggcggcggtacgctgggctacgacaatctgggcgcaatgagtatggagcgcatgtgccgcgatttcggctggaagcccggggtgacggtggaagaggggattgtgcgttataatgaatggcttaagctcgagcgaaactagcttgacggcgtgccgggaaatttccggcgcgcttgctttggttgtattgaattaatgaaatcctcatggtatgatggtaaaagatggaattattttagaagaaagcagggaaatatatggcggcggtaggagatgagaaaaaacgtctgatgcagaccggtgtattccgcacacagaacgatgtggtgacctacctgttggcgcgcatgatcggaaagagcgagtcgccggtgggcgcgtggacgttgaaggaggagctggagcagagcgggatcaactacggaaccgcgacggtcggccgttatctgaaggagctggattccagagggatgacggagcagcggagcaatcaggggcgtatattgacggaggacggtaaaaagtggctggcaaaggtgtccggcaatgtggccagggcccagatgcacaatgaatcctcaaaagcgctcagggtgaacaaatactcggatctggtggatctgatccaggcgagaaaggccatcgaggtggaggcagtgcgccttgcggtagccaacgctacggctcaggaggtggaagcgctgaagaagtcggtgctgatccactaccgctacgtggcggagaaccgggatcccacagagccggctctggatttccacatggttgtggcggatatgagccataatcgttttatcaaggctatgctggacatgctgttttttgaggagcgccaaattgagaacaatatggagcagctggtgaccagggagcgaggggatgcgtatgtggtggagcacgacgacattacaaacgccattgaggcccgcgacggggaattggctgtccagctgatggagcggcatattgacgcacttttaagcgcggttcgggaacagattgagaagatggcggaggaggatgagcctgaaaatgccggagcctgaacaacgggatacgcacgccgggagttacaagagcggcacagagtgaaaagcggtggaataaacggattccaccgctatatttttgactatcacagctcttttgtgatgagcaagggcggggggattctgcgcaaatgtaggggagaacgtttgtgatattgaccatcgatacttgttgacgatgaatggttaatacaaaatatctataaaataaagcttaaaatctaaaaaaataagcaataaaacgtactaataaattcaaaaataaaaaaacataaacatattgacaaaaataatggatgtctttataatataatcatactcatcatagatgagcagtgaaacggaaacgagaaatggaggaaaaacgaatgaaaaaaatgttatcagtagcattggcggcggcgttggtactcggcatggcggggtgcggcggagccggtacgcctgagacggcggcaacggaagcggcgacaaccgcgacagaggcggcgaaggagagcgagactgcggcggccggttccacggaggcagcgaaggctccggaacagtctgcgggcggcaagaaggcggcgatgatcacggcgcagcccctgggggacaagggcgtgacggacaacacctacgagggctttaagagaggctgtgaggagttcggctacgagcccaccgtggtggaggttcaggcgggcgagtacgaggagacgctgcgcgcgttgtgtcaggaaggttatgatattatcatgccctgctggtccgccctggaggacgcctgcgcgaaggtgtccgcagagtacccggacagcgaatttatcatggtattcagtgaaatcgagcttcccaatgtgaagtctctgatcagtaagcaggaggacggctcctacttagcaggcgtggcggcggccatgaccaccaagaacgaccacattgcgtttatgggcggctccgacaacccccagattaacaagttcctggcaggctacgacgcgggtgccaaggcggtcaacccggatatcaagattgatgtgacctgggtgggaagcttcgacgacccggccaagggtaaggaactggcgcttatgctctacgaccagggagccgacatcatctatgtggcggcagcggcttcttccaccggagtatttgacgcggccaaggagaccgggggtatggtagtcggatgcgatgtggaccagaacggaatcgtacccggtcaggtcatcggctccatggtgatcaactacggcaactgggtttatcaggcgttccaggagcgcgaggacggcgggttgaagttcggcgcttacaagtacggcctggagaatgacggcctggatctgctgctgccggaggaatctgtgtacaagaccccggatgatattgcagcagcagtggcagaggcaaaggaaaagatcctgagcggggaaattgtagctccgactgctgttcagtaggtttggtatcgtttgggcatctggaatacagcggctttccaggtgccctttttgcggaaaggagagatgtccggtggcagatgcagtcgatatgcgaaagattaccgtccgttttgacaaggtgattgcaaaccaggaagtggattttcaggcgagatggggggaggttcacgggctggtcggagaaaatggagcgggaaagacaacgctgatgagggttctctatgggatgtacacccatcacgaaggggagatgtacattgacggtgtgaaaaccaggttcacctcgcctaaggacgccatcgccaaggggatcggcatggttcatcagcacttcagtctggtccccagcatgacggtggcggagaatgtggtgatcgggaaaccgccgtataaaaaagggctgattgatctggcgagaagccaggagatcgtgcaggaactgagcgaaacttacggccttaagatcaatccacgggccagggtcagcgacctgaccgtggggcttcagcagagagttgagattttgaaagcgctgtatctgggcgcggagatcctgatcatggacgaacccacggcggttcttaccccccaggagatcctgcagctgatggatacgctgatgaatttgaagaaaaagggaaagtgcatcattctgatcacccataaattggctgaggtcaagctggtgacggaccggatcaccgtgatgcgggccggtgtggtgacggccaaggttgataccaaggatacggatgagaagaaaatcgccatgatgatggtgggccgggaagttatactggaggtcaataaggacgaattcaatcctggagatgtgatcctggacgcggaaaatatctcctgttgcgataaaatggggctgcctgcggtgaaaaatgtttcccttaaggtgcaccgcggtgaggtggtcggcattgcaggcgtgcagggaaatggacagtccgagctggcggatgccatttccggcctgcttccgctgatgtcgggggagatccgggtaaacggaacacgcattgcagggaaaaacctgccgctccagtgcagggaggccggaatgggccatgtgcacgacgaccggatccacgtgggatcggctggggacatgtctatccgggacaatttcctggctgctgtctaccgccgtccggagctgaaaaaggggttgtttctggattaccggaaggcggaccaggtggtggaggagagcgtggaaaagttcagcgtgaagattggaaagatcgcggatgatatcagttctctttccggcggtaacatgcagaaactgatcattgccagggaaatgtatttaaagccccgcctgctgatcgccagccagccaaccagaggcgtggacatcggcgctacggagttcatttaccagcagatcgtgaaacaccgggatgccgggaacggggtgctgctgatttccaacgagctgtcggagatactggccctgagcgaccggattctggtgatctacaagggagagctgattggagagctgagccgcggggaggccacggaggagaaaatcggcatgctgatggccggaatccggctggctgaggacaaggagggaagacaatgaattttgagttcagacagagaaaaataaaaccttccattatcgccctgtccatctgtaccggactggtgctggggacgatatttgtgctgatgggcggatacaatgtggctacggtgtattcctacctgatcaagggatctcttggaagcgtttccgctctgacctccacgatccgctggtctaccattttcctgctctgcggcgtggcctcgggcatcgcctttaagggcggcatgtttaatatgggcacagagggacagttgtacatgggggcgttttccgccacactggtgggcgtttacgccaaggggcttccgcccatcgtgcacattccgctctgcctcgtgaccgggatggcggcgggggcactgttcgcctcggttccggcggtactgcgggtttactggaataccaatgagatcgtggtgacgctgatgatgaactatatcgccatcaatctgaccaatttcctggtgaaggagtatttcctgacaagcggcattttcggagattccctgaccacggacgagctgctgcccagcgcgcgttttcccgtgttcggcgccagtcccatttcctttggattcctgattgggattgtgctggtggtgctgtttatcattttttttaacaagacgaaaaagggtttcgagatccgcgtttccggttataatccggaattcgccagatacagcgggatcagcgttaacaaggtgcgcatttccgtgatgctcatgagcggggctatcgcaggactggccggagcggctgagatcatgggcgtccagggccggttcctgtcgggattttcgccggatttcggaaccagcggaatgctggtggcccttctggggaacagcagtggagtcggaatttttgtctcttccctttttatgggaatcctaaaggccggttccctgaccctggagcgcagtgccggcgtttccagagcgctggcggttgtgattcaggcgctgatcatctgtttcatctccgtgaagtctctgaatctgtcgtttaagcatctgggaagcaaaaagaaggaaaggagtacgcaggcatgattagtgcgagtattatatccccgatcctgcgggtgaccacccccatactgctgtgcgccttaggcggcgtgtacagcgagcgctccgggacgggaaacatcacttacgagggaagtatgctgatggggaccttcacgggcgttgtgggtagctatttcagcggcagcgcgctggtgggcgtgctctgcgccatcctgggaggtgtgtttgtcaatgtattctacgggatgctgcgcctgaaaatgggcggagacaacgtggtctgcggctttgcggtcaattccttctgcgtgggcgcaaccacctacctgctgcggactgtgttcaagaccagcggtaccctgtctgatcccagaatccaggggctttacaaggtgagggtgcctgtcctgaaggacattccggtgattaaatatttctttgtgaaccagactctgctggtatatctgacctttattcttgtgattctgaccagcatcattttaaaacggaccaagttcggtatgaatatacgggcctgcggtgagaatcccatggccgcggccgctgtgggcgtggatgtgaacaaaacccgatggatgtgcattatcatcacgggcgtgctctgcggactgggcggggcgcagatggcgctgggcaatttgacgcagttttccgaggacatggtgggcggcagaggctttatcgcgctggcggcggtgattctgtcccgggccacgccctggggcgtatgctgtacggccatcctgtttgggttcgctgaggcttacgcaaatctgctgcagttgaccaatatttcgtcttatctgatcctgatgatcccctacgccgcggtgatcctgattctggtgcttcagccggaacgcctgaaggaactgcgcatgaagtggaaggtacatcagaataaggcggtatgacggcggaggaaaataaggatggttgatctgaaacggagaatggacggcaggcgcatcctggtggtgggcgccgcaggcgggatcgggagagcctgtgtggagcgtctgctggcggaaggggccgtggtggcggccgcggacctgggggaatgctggcagggcaggccggaggtgtttaaaatgccggtggatgtgacggaccaggaatccgtggaccgcctctttgagcaggtgacggcccgcctgggcggtttggacggatttctgtacagctcgggcgtcggatcctcctgtggatttatggatacgtccctggcacattttgaccgggtgattgcggtcaatctgcgcggcgcgttttactgtgccagaaaggccgcagagcagatggggcggggcggcagtattgtgtttgtggcctcccagaaggggctgtgcggttccacgggaagcctggcttacaatgcctcaaaggggggcatggtggtcatggcgcgcagtatggcgctggagctggggcctttgggaatccgggtgaactgcgtctgcccgggccccacggacacacagatgtttcgggaggatatggggaatcagagagatccgcaggcggcccgggccagtgtggcggcctccaatcctttgaatatgattgcgatggcggagcagattgcagcgggtacggtctatgtgctcagcgaggaggcggctttcatgactgggacggagctggtgatcgacgggggcaacatcgccggggtcagaaatttataaaagcgaggtaggaacgatgaataaaaagattttcaggggcggcaaggtggttttgccggaccgtgtgctggaggcttccctggtggtggagggagagaaaatcgccgggcttctgcacccggggacggagttaggcgccgaatatgaggtgattgacgttgctgggaaggtgctgatgccaggcgtgatagactctcacgtgcacatgtgggacccctcccctcagaattaccgggaggattggaaatgcggatctcagtgcgccgcctcggggggaatcacgacgattatcgatatgccgctcagcgtgccgccggtggtggatgagaggggctttcagattaaatatgaggttgcggaccgggattcctgcgtggatttcgccttttggggcggcctgacgccggggtgcgtgagaaacttaaaggagttggaccggctgggctgcgtggcctacaagggatttatgagcttcgccaacccggattaccctcagatcacggacggttatctggttcaggggatgagaaatgcggcggagttcgacgggctcatcggtgtacacgcggagaacgcggaggcggcggagttcggcacccaggaaatggccgggcgtcagggggctacctgcagcatgcacgacgaggcccggccctggtgggtggagctggaggccatccagagagcggttttgttcgcgagggccacggatgccaggctctatatctgccatatgaccattgcggagggggcggagtttttgaagcaggagagaggcagggggaccaaagtgtatgtggaaacctgccctcattacctgctgtttgacaaggagattatgaatgagaagcggtcctacgccaagtgcaacccgcccatccgcagtcgtgagaatgtggaaaagctgtgggattatgtgtttgacggaacgatcgatgtgctgggatcggaccatgggccttactcggatgaggaaaaagtaaaaaatgggaactttttcctggaatacagcgggttcggaggattcgacgccatgctggccggtatgattaccgagggtgtgcaccggcggggcctgccgcttccgacgctggccgccatcacggccggaaatacggcccggatcatggggctggcgccggtgaagggaagcctgctgccgggagccgatgcggacgtgctggtggtggatttaaatgaggagtgggtctttgacggggagaagagcctgtctaagatgaaaacgcccaacaacctgtatcacggcagcaaaatgaagggacgggtcaagcagacctgggtccggggacaacttgtgtatgaggacggcgtgatcctggttccggcgggatatgggcggtacgttccaaagaaccgcgcgaagtcctgacaatgtctcccccatcacgcggaggtatcgaccgcctcaaacccatgcacccatttcccctgcaaaaggtatatcagaaacaccagggagctcaaactccaggtgagcggataggcccagaatacgatgcggatatccggaaggaaatggattccgatggtgatgtaggtgactcgcaccatacaccagaaaaccatcatcaccagcatgggaaccgtggactttcccgcgccccgcaggatacccgcgacgcagtgggagaaggccagcaggaagtaaaacaacgtgatggtgtgggcctgggcggtgccgatggcgattacctgggggtcgcggttgaaggcggccaccaggacaggtgaaaagtggtagataaacaggcccacaagctccgcgaaaatgatggaacagagtatgccgaagcgggcgccctgtttggcccggccgtactgcctggcgcccaggttctggctgataaaggtggtcatggccagggcgaagcaggtgatggggagaaagccgaatccctcgatggtggagtaggctccgcagcccgccaccgccatttttccgaacttgttgatgttggactgcaccaccacattggccagggcgataatggaattctggaaaccggcgggcagaccacacgtggcgatctgacgcagcatggggccgtcgaagcgaatctgccgggggatgatccggtattccgcccttgtcctggtgaggcgcaccagacacaggaaggcgctgagaaattgggagatcacggtggccagggcggcggccccaactccaaagcccaggaccgcgatcaggaggagatccagcgccacgttgacggcggaggagatgatcaggtagatcagcgggtggcggctgtcgcctaccgattgcaggatgcctacaaatatattatagaggacaaatgccagggagccggaaaagtagattcggaagtagaccaccgattccggcaaaacatccccgggtgttcccatcagacgcaggatcaccggggtatagattaaccccagcacggtcagaaggactccggccacgatgccgaaggctacggtggtgtggactgcctgggacacgctttcactctgccgggcgccgtaatagcgtgcggtgacgacgcccgcgcccacggcgatgccgttgaagaagcccaccagcagaaaaatcgggggcccggaggagctgacagcggccagagagctgctgcccaggaaattccccacgatcagggagtcggcggtggtgtaaagctgttggaacaggttgcccagaaacaggggcagggcaaaggcgatgattcttttccagatcggcccctctgtcatcaggaccgcggaatttttgacggttttcataacggttttctccggggtttaatggatacaatgggcttccggcgcagacagcaggcgaatgccggcgcgaatattcccagaagttattttactacaaatagaaggggattgaaatagtccggagaaaggttccggaaaattgacggttttaagcgggaaatttgatcgggttatgcttgaataacttcacgttaacgggtatgataggagttgagtacagacggcaggatttaggccgtcccggaacggtggaggaaactgaacatgttggagactgtctcgctggccgcttttatgatcggcctttttgtgtgcctgctctctggaatttcgattgtgtacgcgctgatggcggggtacctgatcttctttgggtacgggcttgtcaggggacacagcgcggcggagctgctgcggatgtccggctcgggcgtgaggaaggtcagaaatattctgattaccttcgggctcatcggcatgctgaccgcgctctggcgtgcggcggggaccataccggctgttgtgagctattcgtcccagctcataaggccttccgcgttttttatgttcgtgtttctgctcaactgcctggtgtccgttctcacgggcacttcgctggggacggcggcgaccatgggagtgatctgcatggccatcagttccgccacgaggatgagcccggtgatcaccgggggcgcggtgatctcaggcgcttatttcggcgaccgctgttcgccggtttccaccagcgcgctgctggtgtgcgagctgacgggcacggacatttacgacaatatccgcaggatggcggccagttcggttgtgccgctggggctgacctgtcttttatattacctgatgggaatcgcgggcgccaatggcggggtgacgctcaatgtgcggcccatatttgagcgggggtttgtgatccactggctggcggttctgccggccgccgttatcctggccctgtccgtgtttaaggtcaaggtgtggatgacattgtccgtcagcatcgccgtggcgtttctgaccggcatgtttctccagcataccggtcctctggagctccttaagacggcggtgtacggataccgggccgcggatccggagctggccgcgatgatgaacggcggcgggatgatgtccatggtgaggctggcggtgatcatcacgatttcatcgtcctacgccgggttgttcgagggaacccaccttctggatcatctgaagctgcatatggaggaggtgggcagaagcttcacgctctacggcggaatgctgttcgccaccatcgtggtggcggcgatcgcctgcaatcagactctgaccattattttggttcaccagctgttttgcggacaggagcgggagcgcggcgagatggccgtgaacctggaaaatacggctgttgtcgtggcgcctctgatcccctggtccatcgccgccgcggccccgctggcctccatcggggcgaccccggccagcctgtttgcggcctgttacctctatttgctcccgctctgttgcctgatcgggagcctgatcaaacggaggccagagtcagctgcgcgggtgggaatgggattcaggccgctgcggcattcctgaacagagagtagttttaggggtaattgaattttagcgggaaaaaagccaaccgggcgcggttggcttttttggggatgcaggtgaggctttggaacatgctgtgtggcaagtcttggtttagcggctgccagctaagtcccggttcaacgcccgcccgccaaatcccgtttcagcgtttgcccgccgtatcccggttcaaccctcacccgccaaatcccgcgtcagccgcctccggcccacatagcggtagattccccaggacaccaccgcggtcagtccttcgctggctccgaacgccagccacacgccgtttgcgcccagacttctgctgaacagcacggccaggggaatgataaagagcacgtaccggcaaagggaaatgacaagggagggcgcgcccatcccaagcccttccagggtgccggaaaccgtaaccgagataccggagacaaaaaagccgatgctgatcaggcggatggccgtaacgcccagggcgatggtttcccggttggaggtaaacagcccgatcaactgggacggaaccgccaggcagagcgccgtgccaagcagcatgatcgtcaggatcatggcaaggcccgtgctgtggattctgcggactctccggtattcgcccgcgccgaaattatagcccaccagagggcgcattccctgtatgattccgtttgcggacaggtataggaaggtttgcagcttgtaataagcgcccagcacaaggacgtaggcgctgccgtatgcgctcagcacggagtttaagactgatactaagagggagggcagagccaggttcagagtggcgggcacgcccacggcatagagccggcggatcagggcagagcttacggcgcccgggaggcggcaaaaggttacggagatcgggcggccaaaataaaacaacaggtagatggccagggaggtggtctggccgatgccggtggcgatggcggccccctttattcccatcgcgggaaagaatccgatgccgaagatcagaaacgggtccagaataatattggtcacacagccgcacatcatactgaccatggatacggtcatctttcccacggcctggaagatcttttcaaatgaaatggcgatgacgttgggcagcgtgaaaagcaggacgatattggagtattgaagccccatttccagtatggcttcatcggcggtgaacaggcggagaaaacccggcatgagccaaagtccggccgccgtcaggagaaagccgtggacgccgctgagcagaatccccacggtagcggcggtgtcggcgctgccctgttttccggcgcccaggtagaaggccaccgcggaattgatgccgatggcaaatcccacggaaaccgcgttgatcagattctggaccggaaataccagggacagcgccgtcatggaagcctcgctgatctttgccacaaagtagctgtcgataatgttgtaaagagaacccactaacattgagagcatcatgggcaacgccatggacgtcagcagggggaatatcggtttttctttcatgtaagcctggttcatcgtaacacctctgtgattgatcattgtttttggcgcaaaaaaaccacacaattacggcggcgtaattgtgtggcgaaaaatggaatccatgcacagcggatccagaaaaatccacatccatgaaaaggcatggttttagaagctgttgtgagcattatagcacagcctaaatcagaatacaagttattcccttcctcccgtccatccaagttttatatatcaaaatcccgccaattatgataaaatcaaaccatattcaaccttcacgacaatgattgattttatatagacaggaggcggccgcaatggatcgaggcgagatgacggagatttccgggaacaacttgggatttttgatgggagatgaacggtctccgcggcagatggtggagtttttaaaggagggggcgcagctgcgcagctttggggacgtgctgcggcaggtctacccccacgaggatctggcggcccggctgacaggcgggctgggggagatcacgggggacagccgggacagtctcgcaaaaaaagtgcgcaactggctgaaaggtcagaatatgccccagaaccgggaagtcctgttccaggtcagctttgccctggggcttgatgagacgggggcctccagattattgggcgcagccgcggagacggggatccattaccgcaacccggaggagctggcctacgcctttgccctgaggaccggggcttcctatgagaaggccctggagttaaaagacatggcgaatgcggtctgcggcggcctgatggggggcggcgggaaggaaaaggcgcggggcgggacaccttccatttacacccgccagctgcgggacgccttcagtcaggtgcagacggaggcggagctggaggcatttttccgggaacacgcgggcgagctggggcgtctccatgagaccgcctatgagaaatttcacgagctccttggcctgctgcagaagccggtgggagagcgggaccgccgggtgcaggagaagctggaccgggaggacgaggagcgggagtacaccatgcgggacgtgattgtagagtatctgggtatgaacgtgccggaggcaagaaatctcgcggggatgacgccgcttcagcgcctggtgaaacggttctggcccaacgagagcagcctttttaacatgcgcaaccggaaggaggatgtctcaagaaaggtcatgatccttctctacctgattacagaggcttttgacgaggagccggaggatgaggaggacgattacccgtatgatctggaggatgaggacgcggatacccgcctggagatccggtttgagaaaatgaacctgtttctgaatacatacggcatgaatttgctggatcccggaaatgcctttgatctgctggtcctttactccatgaaggcccaggaatcgggggagcgcatggcggaggtgctggacgctctgtttatgggacaggggagacggaaaaaggttgaagaatctgaaacggggagagggtatgataagggtgaagcataatcccgtatcagagaaccggcagccatgactgccgggctaaaatggaggaaattaaatggagagcgggcggaaattgagggctgcgggggagattctgcggctgggaggggtggattaccgtctggagtccgtggagggctgcgggggaagcgcggtggtctaccgggccgtttatgaggatgagctgaaccggggctgtttccatcaggttctggtgaaggagctgtttccctatgaccccaggggtatgatttaccgcggggaggcgggggaagtctgctgccgtccgggggcagaggagcggatggaggtctgccgccgcctgtttcttcagggaaatcaggtgaatctggaacttttggcccggcttccggaggaaatttccgggaatttaaattcatacgaggcatacggcaccttttactcggtgctctcagttcacgggggcaggacattagaggaaatgctggaggcgggcgggccctgcggccttaaggaggccgcggagtggatgacgtggattctggacggactggaatgcttccaccgccatcggaccctccacctggatataagcccggacaatattctgatgctgaaaaaccgggcgctgctgatcgactacaacagtgtgtggcagatgggggcggagggagcggagcgcttcttgttcagcgagaaggaaggctacaccgcgccggagatccgtctgcggcagatttcccagatcggcccggcctcggacctgtattcggtgtgcgcggtatttttccgggttctgaccgggaggcggccgtcggaacaggagatcatgggccgggggccgggaaaaagtctctcgcgggatctggagatcttcgcggaggagccgctgccggcggtctggcaggcggttcggatcgtggtgagagggcttcacgtgctggcccggaagcgctggcagtccgtggagtgtctgcgcctggaatttgaggagctgatccgcagaattgacggcaggggaatctcccacagcgcggtctgggagagcagccgcaggagtttaaagcgccttcggaagccggacggcctttttttgccgcggagtctgaccgtagagggtaaacctatggacggccagacctgctttcaggctctggcgcagggaggccgcatccttctcaccgggccgggcggtatgggaaagacccggtttttgcaggagcttttggggcggaatatgcggatttaccggccggaaagtccggcggttgtgtacgttccgctggtggattaccaggaggcaggggaagaaccctactacatccgcaagtggattctgcggggcctgcgctattccggtcaggccgggagtatggacgaggcccttcacgagctggaccgcctgctggatcaggggagagaggaaggcggcggtgtcgtgctgcttctggacgggctcaacgaggcggggcgaaaacggcgtgctctgctccaggagatggaggaactggggaataaaccgggcgtgggaatcctggttacggaccgctccgattcggtgaaggaatacgggcttcgcgccttttgcacagccagccttctcccgctgaccggagaacaggtgctccgtgcgctggaagaggacggccttgcctgcccgcaggaaggggagctgcgggacctgctgcgcaatcctatgatgctttccctgtaccggaagacggcccggccggatcaggagggcggaaatgtccccggggatatggaggagatggtgggacgctatctggagagcctgtacatccgccagctgcgcgcggattccggcgaccaggcggaacagctgcgccaggggtatgtgttgcggcatctgctcccgctcgtcgcctgggagatgaaacgccgcaagcggactattctgacctttgaggaggtccaccgcgtcgcgggggcgagctaccgggaactgctgcaaaaggcgttttctctgtcatttcccgagtatgcgggtaaatccagactgatgttaaaggatattgccaatgagaacgaatggtttgactacgcggtgtccgagcagttgatggaacgcctgaaccttctggaaaaaagtgggaatggatattaccggctgatccacgacaattttatggattatctggtgaaagccgcgggggagaaccggcacaggctgggacaataccggaaaaaggtccttggactgcgcctgaccacgggaatcctggcagcggccctgctggcaggcggggcggcggcggtttaccggtcggtaaggccccgggaacttaccgaggcggaaaaatacggtatccggaacgcggctcagcgcctgatgatcaacctgcagcttctggacacgcagatggtgctccagcggggcgttcttcgggaagcaggcggggagggagttctggaagggaatacccgggagacgggttatctgagggaacggatcggccgcgccctggatcaggaggcccgccagggggcggtggcaacggacggctccaactggctggaggagctggagctccaggggacggagattcctctggacgttttggggaggctgtatctgaaaaaccaggagatgagcggtattatggaggaggcgctgggctacctggagcgttgtctctgcgacagcgacagcccttaccgggaccgttccaaacgagaaccgctggtgaaagcctatgaggcatatctggacgcttacgcggaagcatgttatctggagctgcttcaggtgatggatcagatggacccggaatcagccaagacggtgttggatgcggcggccggtatgagcacgtttaagcagtatgtgttaaaatatcctctgagcaatacgcaggaggaggaactgagccgccagcaggccgcggcagaaggccagctgaaggacgcccgaggagagctgcggcagcagaattttcccatgacggctgtgggttggtgacgaaaaaacggagatgcaggggagcgagatgaaaaaaatgatgagaaaaacggggtttggcggagcgctattgatcatactggcttcagcgctgctggccggctgtgggaaagaggcggacgacagggagaattatcggaagatcgtggacgattacgctgtgtttactttggagcaggatggggacagcgccgcctatgacagggctttggaggcggtagggagttatctggaaaacgacagcggagattccctggagaacgccaggaaggtggtgtcggacacgcttgaacagatggaatcggatgcggataaggcggtttcctatgagttgagcgaagagttggccgccgttctcgtcgaatacggggtggatcaggaggagtatgcgatcaacgccaatatgcgggccgcatatttgtccgactatattgagagcctgaaaacgctgcggtattatttggagccggagtccaaagcggagcgggatctgctgcgggatgatctggcgttcctttacgggtttcagcgggacagccagaccagcgagaaaggattttactattacagcatcaattactggtttgcgggctgggatggggatcagaaggcgtatgtggaggagaaggtaatcaaaaacctgaaatcctacgaggcggagaacccagtctgggaggacagccgtgatgcggtggagcaaaaaatgaatctgtacctggaccagatggaagaattacagtaccggttggaggaacacatcggcagaagtcaggaagatctgtatcaaatggaactgccctctgaatagaggggaaataaatggattgctgagaagaaggagcgaaggctccttctttttgtttggagataatgggccgctggcgcagccaggatcctcaaaaccgctataaagtcctgcttaacccctttaagtaggccagggccagctgctgttcctcctggctgagggaggtgaagagggagaggcacagagcctggtctttcgtcagtccctgcaggtttcggtcgggttcaaaaaattccacaatggagatgccgaatccctggcacagcttctggagcgttggaagggagggcatgttttccttattcagcatggtgttcagggtggagtaggggatgccggaagctttggagagttggtaataggaccatttgcgctgctcgcacagttcccggatccggtccaggggattcaattcattcatgtaaaacctcactgttatcagtatgtgcaaattcatcatatctgattatgaaacaatcgtacagatactaaaaaacgtttcaatacagacgaaaatacgtcgcaaagccgggacggacaaacctttcataaaatgataaatcagttttgtataatacggtcataaagaaaacagacaggcagaagggacagccggtgagagtagaatttttccaataaaacgaaaatgcgttgattataaaacggaaaaacgctataatcatagagaaatgtggcaatatttggattcatttctaagtgagataaaaggccggggagaggagagcgctgtatggtacagacaggtgagacaatatacggttttcagggacaggcataccggatcagggaacggaagggggctggtggagaggggaccgtctatctgacggaccagcccggaattgtggccaaaatctaccacaatccaacggcggtgcaggagcggaagcttcgctgtatgctaaataagaaaatcgcgacaaaagcgccgaacggaacctccctgattgcgtggcccaaggatatactttatcaaaatggagtctttgcgggctatacaatgcctctcatcgaggcggggaaacccatatttacgttatatcacgataaatccacccgcgagttcttcaacgattacaactggaccaaatctctgtgcgtcgccatgaatctggcccatctggtggacatcatccacaactgtgattgcgtgattggggacatgaacccgggaaatataattgttcatcccaatgggctggtcagcatcctggatgtggacagctttgatatcacagacccggccacgggagagcactttaaatgcggggtcggaatcccggattacctggcgccggagctccagcacaggaggagtctgaaagatgagtccagcaggtttacgaagcacaccgatgaattttcgctggccgttcatatattcctgctcctgtttcactaccatccgtttctcgccaggtcccttaagacctacgtgcagtcctcggacgtaaaccagattgaccagaatatcgccaatggagtttgtccctttgttcaaccggtcaacaatgtggcactgccggtgggcgctccggagttgggcctgcttcctccgtttctccaggaggatttcaagcgtacctttggatacacggctttggacagtattacgaaaagtgctcagcggaccagcgcaaagacctggtatgagcatttgaaatcgctgtatggcggcgtgggaacgctgatggttccctgcgggaagaatccggagcattaccgcagggcggaccagccctgtgaactgtgcaaggcgcaggcgcggttggacgcctggatggcgcagcaaaagggaggcgcccagaatcgtcaggccgcaaaccggcagacagcggcggccaatatggcggcgaaagcgccgcagccgcagcccaccccgcagccgcagcccaccccgcagcccaccccccggaaaaaatcgggaggtttttacaaatttctcctgatcgccggaattctggcaactttgctgggagtctggtacgccagggaatccggttccgaacagtccagatatgagcgggctgtgacgttaatgaacagcggggagtatgtggaggctatcgatatctttgaggagctggcagattacgaagacagcgaagattacttactgcttgcgaaggcgggttatgtggacggccatctggatcatgaggactcgcggacctattggtatctggaggaactgaaggacctctctgagggctatcgggaggtctatgaaaccctgtaccagtggaaggtagagtttttggccgtgaatacggaggaggatgacactaccacggatctttcatcagccagcgcagagaacaaggtatactggcattttaagattaccggcggcactcccggggctgagacggagttgtactatcaggtatttgtgacaggggagaaggcggaattcgaaaagttcaacgatacctattacaacaattcaagcgggtggattcgggcaggcttcactctgcaaaacagcacaacagcgtactgccgcatctatgatgaaaataaagagttattgggtgagaaaagtataaagattataaagtagcattcgcatgggaggtcaagatgaagacggaagaaaataaacctttggacgctctgggggcgtttcctccgaaacaggagggaaagactttacagaacgggaaaatatgcgcgttcgccgtttctctgcagggcgcatcccatattgcggggggaggcgttccgtgccaggattacagcgatatccgctggctggaaccggcgcagattttggccgcagccattgcggacggcgtgggaagctgcgcgctgtcccattggggctcgtattttgcagtgacggcagcgctggggtatatcgagaaggccgtgcgggagaagggcggacacgggccgtatgagctgacaaatctggcagaggttcaggaaatactcaccggcgcgtttcacgcggctcagggcgaggtggaacagaaggccgatgaggcgcagcaggcggtatttaatttccaatccacgctgaccgtggcgctctacgatggggttcacgtatattgctgccactgcggggacgacggagtggtcgtgcaggagcaggacggcgttgtaaagatggtcacaaaacggctcaagggggaggaggccagcagcgtttatcctcttcagagcgggccgtcgaaatggcagattacggggaccaaaaatccggtggcgggctttgttatggctacggatggggtgctggacgcctttgtcccgatttttgaggactattacggcgtgaattactgccagggaatctattatccgtttatgaaaccggcgatggacgggctgggtgattccggcggtttggccgcagagaaaaccctggcgtattataaggagtttctgaacagcccggattaccgcagaagggtgacggacgatctgaccgttgtggccgtggtctcgccgcggcttttgcgtcagtccggtcaaccacgatttaatgtaaatatttggaagtctgtttatgaggaacacgccaatgcggtcagggcgcggctggaaggcaaaacggttgacggcggggaaaattctcctgcggttccggagaaaacggaagcggcgcaatatgagagaccggctgggccggaatataaaacggcggcccgggaaccgaaggaaaaaacgcccaaacgccgcgtctcaagggcggtgtgctttttagccggattgctggccggtgcggccatagccggaacaatcgccttttttaccggcggcggggaggcgtccgcaaggctggggacagagccggtggtggtggagttattaccggacaaggcggaggagccgtccgaaggccgggaagctcccggcggggacaagccggtagggccggccagtgcctcccgagcgggaacggccagcgcttcggacgccgggaagcaataacatgtgatagatagggaaaactccgcgcatacggacggcgggggaacccctgtttcataaaagattacaaaggagagtgtgaagatgagtgaagttttaagcggatttgaggaaatgggaaatgttgtggacaatgtgggagagcgtcacatcgcgtgcgtgctgctggtggatacctccggctccatggcgggcgcttccatcaacgagctgaaccagggactgctggaattcggaaacgcgctggatcaggacgaacatgccaggggcgtggcggacgtgtgcgtcatatcctttaattccaatgtggagacggtagtgccgttctgtccggccgccaattacagtgcccccacgctgtccgccggcgggctgaccagtatgaacgaggcggttatcgccggtctggacgcgattgaggagagaaaacagctctacaggcagctgggctgctcctactaccgcccgtggatgttccttctgacagacggagaaccgacggaccagaacatggagggagaggcgaaaaacagattgcagcaggcgctgaatgacaaaaaggtgaatttcttcccaatggggatcgggtccggcgccaattacgcccatctgaaatcttacaccaagggggggaatggggctgtgttaaaggcgagcgcaagccagttcaaggaggcctttgtctggctgtccagcagtatgagcgtgatcagcaattccgatcccagccttggaaacgttacgctggagcctacgcccatgaccatcgagctgatctgacggaactgtttggaaggccggcgcgctgactgcgccggccgcaggaagatatggaaaacgagcaaacatccacacggatgatggaggattacaatggccggtgcgggatctacactcattggacttaaaggaaaaaaataccagcttcagtctgaaaaagcaaagggcggggaaggaaccgtgttcgtcaccggcgacccctctgtggttgtgaaggtttaccatcatccggacgcctggaccgagagaaaattaaaatgcatggtgtgtcatcccttaaatccatatgcggacggcgtgcatctgctgatcgcctggccccttgacgtggtgtacgaaaacggggcgtttgtaggatatgcgatgccctttgtaaaggacacctaccccatatatgttttgtgccggaacaatgaatcccacacccacgactgccacgaggtatttccgaattacaactggaccaactcaatcgcggtggcgtaccacctggcgtgggcggtgaactacattcatcagcacggatacattgtgggggacatgaattccaacaatatcatgattcacagcgacgggagcatcacaattctggacgtggacagctttgatattacggatccggataccggagagcggtttgaatgcacggtgggaatctccgagttcctggctccggagctgcagggaagggatctgcgcaaggcaaaatttacaaagcataccgatgaatttgccctggcggtgcacatcttccagctgctcatggggaacgcccatccgttcaacgtaaaggtggtggacagcgtcaagcagtccctgccggaaaataagctggaaatgaacattgtcaacggaaactgcccttgggtaaaggccattgacgggatcacgactccgccgggagcgccctatctcgccatgcttccggccaggatgcagacggcgtttaagcaggtgttcggttacaacgcaaccaacgctgttgcggtcagctcccggagaatatccgcggatatgtggcggcagcttctgtacatgttctaccagagagctgtcatgcaggggggagatctgatccagtgccaggccaatccggagcatttctacctgaagggccggggctgcgaattctgcagggcaaaacagcgttacgagcggtttatggcgcagctgaccgccgcccaggcaaagaccaaagggcctggggcctcgggaagcacaggtaattcaggcaattcaaatcagacggccgctgtggcgcagagcgctgcggcgaacaccggcggaagttccaaacggccgtggtggatgcgcctgttcttctaagttaaggagtgtttatgaagtttgatcgcagcgaagggttacaggaagagagtacggcggaggttaaggaagattttggaacaccgccgccacctgagaaacattatgaagcgctggcggatatcagcgtgtatgggatgtccctgcagggaagctcccacgttgaacgctgccagccatgccaggattacagtgatttccgctttattccggaggcgggtttgctgatcagcgccatctcagacggcgtgggaagctgtgcgctgtcccactggggctcctacacggttgtgactacggttttaaatgtgctggagacggaattgaaggcggtgcttcagacaaaaaaatttacggagatcgagggaaaaaccatcggagcgatcctcagaaaggcgtttttgcagagcaaagacgcggtggaggacctggcggaccatctgacgcagcccctgccgaacttttattccactttgacggccgctatctatgacggaagtgtactctactacggccatgtgggagacgacggcatcgtggtgcagttggagaacgggtcatatcaactggtcacaacccgccataagggcgaggaggcgaactccgtcaatccgcttcaggcgggggcaccggatcaactgtggcagtttggccgggtatcggagccggtagtgggctttctcatgtccacggacggagtgctggaccagtatgtggcgaataagcagcggaataaccggatattctacccatttctcgaaaatacgctttactccatggccgggcaggagggaaaatccggggataaaatcgtacgggaagcttttgagggcatgcggtttatgctggaccagccggagtaccgaagtaaggttacggatgatatcacggtgctggcggcggtcaacacaaagcggcttcaaaacgcggtgcatccggtattttcagtggaggactggaaggcggaggaggaagaataccgccgggaaatccaaaagaagctctacaccggtgaaccggtgggccagagcaggcctgcaaaacctcagacgggccaaaaaacggaccagagggcaggccgccatacggacccgtggcaggaccagcggaccagggggcagacggaccagcggaccaggggacagacggaccagcggcagggacagacggatcagcggcagggacagacggaccagcggcaggggcagatggaccagcggcagaggcagcggacaggggggcagacggaccaacggcaggatcagcggaccggccgtcagacggaccaagggcgggaccagaggacgggccgccacgccgacccggaacgggaccagcggacgggccgcggggagcgcaggaatgataaagaccaggacggcatagtcgaggtgatctgcgtgtcggccaggaaaacgctgggaaacctggttgaatttctgcgggatccgatggaggagccgaagatgtgttactgtcccaagtgcgggagaagttacgaaattaccagggggaattcctaccgtttctgtccgcattgcggcagtaaaaccagacccctggacggagatcagttttggtgaaaatgatgagtcggaaaatggcatttcggggactgcgggtatcggattttatacattcgcaggaattggccgccaaggattccctggtaaactcaccggcgggtaagaagtttgttaaaaccttcggggatcttaatttaaaactttacaagaccattaccgagggcacctatgtccggcttcattcccaggcggccccctcgcttttcagaattttaaaggatgtgtgccggatactggactaccgggagacggaactgccggagatctatgtgtatcacgccatggatcacacggcgcggccctgcagtgcggatcacacctatattgtgatggcggattatgtgctgcagtcctacgacgaggatatgctctactacatacttggcaacgcggtgactatgattctggccggtcatgtgaaaatgaccacggcggcggcctatatgggggccagcaggctgttactgctgccgcagctggaattcaagcggtacctgcattttgcggacgccacctcggaccggggcgggctgctggcctgccagtcctttgcggccgctgcgcgatgccatctctttgagctgggacttccgcctgccgagagccggaaactgttttccacggatgagcaggcggctgcgtttgttacacaatatataaaagaggcggagtccggcggtcaaaaaaacaatttgatgacggatctggcggcaaaatggatcagggccaactatattgaagcgccgggggaggagatgttaaaggatcttctggactggtatcaaacggaatacccaacgctgattcaaaaataccgcgggacttaagatggcaggaggagaatcatatggtaccggcagaacgccagatacagcccgggctgtatcagcatgaaaaggatcaaaagctgatttcagagatcatgagccatcccatgacggaaacggtgttccagtggctccgggatcaaaatatcgatgatatttacacgtacgtgtaccgggaatcctgcgtccgcctttcccgcgaaaacgctttggatgtgatccggaccctggagcgcgcctgcgtccggttcggctgcgcggaggttccggaaatctatcttattcacgactatgaccggaccatcgagatttgcggaatcggcaggccgttccttctggtttcctctttctatttaaaaaccctgaagcgggagggggagcggatgatggccggtatcctgggggcgcaggccgcagcaatccgcgttggacatcaccggggactgctgctcatctgggcgctcgatgcggttttacagcagatgagtctgcccaaagcggcggtggcggccctggcgggtctgctgaacgattggaagcgctgcaggatgtacacctgtgaccgcgcgtttttggttctgaccggagattaccctctgtcgatccgaagcattttcctcaaccggcttccacgggagattctggacggctttcgatttggcacaccgggggatttgtaccgggaacagatggaacgttttatccatgcggatggactggatagtttggtgaatatttacaattcagcggccaccgaccagagctggctgccgctgcgctatcaggagctggagaaattctatcataagacaggacagattgaatcgaggaaagccgatgattgattaccgttatccagaggaaaaggccgcgctgcatgaactggtccggaaaaaggaatttcaggccgcgcttaaactgtttgagaagatctacgcggacgccacggattttgcccggctccagggaaggaatttcagggttaccaaagccgcacagccgaggctgcactacctgtaccggcttgcggccaggcggctggaattccgggaggaggttccgatgtatctggagctttcccaccagtttgccccgaagatttacggcacggacggcaaatgcgcggtggttttgagcagcatatgcctggaaacgctgacggacccggagttgacggcgatgttcgggagcgccatttcccacatacaacacgggcatgtgaaatatctgaatatgggaaatctggcggacgagctgttcctcagtatcccgtttgtgggaagcgcggctgctatgatggtcaaggccctcctcgttcagtggcgcaaatacgcggagtttacggccgacaggggagccgctgtggccgcgggggacgctcaggcggtattcggctatttaagcaaatccatgggcacctccactgtgtttcacggctggccgaaggaggagcgccgccgtccggtggagtccatgtcaaaggcggagcggatggtctatcagcttctggcggaggatatcccggttccctttggggttctgcggttggagacgctgagggagtggctgtgctcacagcagtgccggcagttcagccgttccctgtactgcggggggatgggggagacggctgcctggagaggcacaagcgctctaaatcccgcggatcggggaaaacgcttttatcaggaatcgtcggcgctctttcaaacgaatccggagcgcgcgatgattctgctgtacgccgccgcaagctgcggttatggtccggcccaggattatctggggcgctgttatattaacggagcgcatggaatcgggaaaaatgatctggcggggctccagcttttaaaggaagcagcccgcaaggactgcggcggggccctgtccactcttggaacgctgatgttgaagggcgccggaaccattttgccgaaagatgagagcctggggcgccgcctgattgagcgggccaaaatcgtaggggacagggggaagaaggatgaagtacacgattaacccggatatctactatggacgttacggcgaatatacctatgtccgcaatgtccgggacagaatggattacctgtacaatgagatatgctacgacgttctggaggctttgagcgttaagggcggccgcacgcccgagcagctggcggaatacctttacaccgtctgcgaagcggattccatggaccagggggatttcatggataccctgcgctccgacatggaagagtttttggaagagcttgcaggagagcgcattgtggcggcggaggaactgggggagaggcgtgcgggggcggagccgccggaccgcatccgggattttatccgggaggtgtgttaccgggagcggcggcttctcacggtttgcctggagctgacttaccgctgcaatgagaagtgcatccactgctatgtggacgaccaggagagcggggccggggagatgtctttttcggactaccggacgcttttagacgagattcgggagctgggctgcatgggcgttttgctgaccgggggagaacccaccctgcacagggatttttttgagatcgcgttttacgccagacggatcgggcttatggtggatatctataccaacggcctgtatgtggacgacgggatgatggaccggctgatttcgctgaggcccaacagtatttccttcagcttttacggtgggaaggcggaggttcacgacgccgtcaccggtgttccgggatcctttgagaaaagcctgaaaaccatgatgacctgcaagtgcgccgggatcgatacctttatcaaaacggttgtgatgaagcagaacgccgggaggtatgaggagcttttgaagctgggaaaacgcctggatatccgcgtcatgtccagtttgacagtcatgcccacccatcgggggaagccggccggggcgtaccgcctgatggacccggaagaatacaggcggatcctggagctggaataccggtatgggcttcacggcacggagccaatggagggggagcggggggactacgtgtgcgccagcggtctggacgctctgtccgtgaatccctggggggaaatctacgcctgcaacgccaaccccatcgtgttgggcacggtcggaggcgatggcatcaggaacgtatggaatacctctgaggcgctgcgcgggatcaggaatctgaaattccaccagatcagcggaaactgcggcgcctgcgcggataaaaactggtgcggaatctgccttggaaatgcgctgcgcgagaacggttccctaaagccctgctccgatacctgcatgatcagtcgcgccagccatgaggtttacttaagtcacgtgaaaggaggtgagacggatgaaaaagtataaagctccgaaaaagctgaaagcccagaaggcggattcttacagcaagacctgcgcctgcggcatgttccacagctgcggtccgctggtggtgaactttcgggtgaattaactgttacacgtgagatacaaatacaggagatgaaaaagctgctttacggaggatggcacaatggcatatacgagcatttatgataagattttgcggaatccctataaaataacctggttggatttgttttccgacagtttgaaaaagcacagcaggcaggacatggagtacgccatgatcgccggtacctccatggattccgccacagagtccaacatgctgcagaagtggaggaaaccgtggctgttccgggcgattttgatcggcggaatcgcaatttcgtttattatttttgcgattgtgtatgcctgcatccagctatttgagatttcccatatcgctgcgctgaacctgctgtttgtgatcgttccgcccatcgttgtgccctttgcgctgatggtgttcttctgggagctgaacgtgcctaggaatatttcgatctaccagcttttgggctattttatggtgggcggcatgctgtcgattctggctaccctgatcgtcgatatcgtggcgccccagggggccgcgtcgctggccccgttcagcgaggaaccgggaaagctgattgtagcggcgcttctgattaaactgttcggatccaacaaaaaccggaaagtgtacggaatcacgggactggtgatcggggcggcggtgggagccggattcggcggttttgagtcggcccagtacgcctacaatatggtggactgggtacaggtgggcggtttctatatctgggaggaggcctttgaagcgatcgtgatgaacgaggcgctgagaggggcctttgcggtctgcggccacaccttattctgcgccccctatgccgcggcggttgccctgcatatgaacggcaaccggattacaaaaagctgctttcaaaaccgggatttctacctcaccttcgccgcttcctttatcgcgcattttatatggaacaccaggacggaatcctacaatgccttttttgcgatgaagctggctctcaccatcgccattttatggttcagcgcccgctatgtgctcagaaaatgttttgcacagctggctgccgccgcggcctccaaccccagagacaatctgctgccgaatatgaaggtggcggggatcagcggcacctttgccaaccgcgcctttgggataaaaaacacgcaggtatttttcggaacggactccggctgcaatctctgctatcccatgggtaccgcgggaatcaatgaaaagcactgcgaaattctggtgcagaacgggcatatgtatctggcggatctgggttccacctacggaacctatttaaacggcgtgcagctgccgccaaaaaagggctatctgctgaagacaggggatgtgttttacctggggtccaaaggggagtcctttcggattgagggggtttaggtaactgttcagtaggtctgcgcacttgctgcgctgaccgtacgaagacctgagcttgcaagcaaaaatcccatcgccgaaggcgattttcatggatttttgcacgtatctgtgaaggtactgaacagatacgcgtttaggtaaaagttgaaaggaaggagagacggatggagacggattggagaaaggttatcagatggctgaagggcttcgggattttttttattttgatcggagtgtttgtgattgtctatgataccatctactcgctgcccgaccgggagggcggacttgtgttcatcggcataggtcttattctcttcgccgtggggggaatgatccggcgggaatgacgggagagtggaaaatggttgaattttctacaaaggggatgtggtaaactggactcatcaaaaacagggaggaaatgtgtatgagcacgacggaaaaaggggagcggctttcccagaccgtgattgaagccaaatgttttctggcggaaatggcattgaaacattccgactatgaatatgctgtccagatttaccgggaaattctcgatctgacggattccgggcttgcggcgtaccagctgggggcgctctgcgccatgggaaaggggacgaaacaggattttttggaggcggcttactggtttttccaggcgcagagccaggggaaagaggaggccggccggctgcttgccaggagtaccttggattatttcaggcaggatctggaccggctgactccggagctgttgtggaaaaaggcggcggacttttcagagcgggttttcggggaacaggagacgcgggccgcgtccatttcctgcctgaaacagatggtaaatttctgtattgagaaggaagattttgaaaatgaggtaaaaattgtccgggcgctggccgaatacgggaaggacgcggagtcccagaaccggatgggcgtgctgtacaaccgggggatcggtctggaacggaatgatctggcggccctctactggttcaacaaagcggaggagcagggaagcgctggggcgagagcggactgcgacggaattttccaggcgtattccaggagccttggccgggaggattttgcagagcagatcgggctgttggctcagtggtgccgcaccggcagaggtccggttcccctggaccgggaacggggggcgttctggaccggtcggatggaaaaaatattgaccgggtccgaccggaaagggatctaagctaccggcgtgtcctcctcaaaccagctgtgaccgtggcggttcagaagttcctccgcctgcgcaggaccgcgttcgcccgggcggtaggaatacaccggaagccctgcatgcttgtacaactctttcaggcgtccgatgaaattccatccgtactcgatctggtcccactgggaaaaccaggagcgctctccctggatgcaggcggtcagaagccgctcgtaggcttcaggggtgttcagctgatggaccaggttgcagttctggcagaaatccatcttggccgggatgatatcgtcggtgtccccaggccgcttgatgttgaactggaggtaaacgccttcggtgggctggattttgataatcagcacgttgggctccacctccgggtaggggcggcggaaaatgacggagagctcgatctggcgggttcccgtctttttacctgtgcggatgtagaagggcgtgccgcgccagcgctcgttgtcgataaagaggcgcaatccggcaaaggtctccgtggaggagtccggggccaccaggggctccttacggtatccttcgtactggcccagcaccagcgtgtccccgatggtctcggggccggcgggcctcaagtcccggaacacgcccagctgtgcgtcgtgaagtcccttgggtgtgaaggattcaggctgttccatggccatgatggacagaatctggaacaggtggttctgcaccatgtccttcaatgcgccgctggcatcgtaatagccgcctctggtctccacgcccatgtcctccagggcggaaatctgtacggattcaatatgcccggagttccagatgtcggtgaaaatggggttggtgaagcggatggcctggatgttgcgcaccatctccttgcccagatagtggtcgatgcggtagatctgctccggcccgaagtagtcctccagcgccccattcagcgccttggcggccgataaatcctcgccaaagggcttttcgatgattaccttgccgttttttgcgccgtccaccagcttcaggccttccgtgatcacgctgaaaaagcggggagccacggcaaagtagaagatgtgggagccgatgcggtttccggcgtaataccggttcagcccgcggtaggcctcatggtcggagaaatccatgcggtaatagtcgatctttccggcaaacgcctggaagtccgccggcgtgaagggcaggcgggtgaatttctccacccagctccttgccgtctcgcggtaggcaaagctgtcgtagtcccgccgtccgatgatgaggatgcggccgttttccggcagtttcccggccacgtacatggtgtagagggccgggagcagcttgcggaaagtcaggtctccggtgccgccgaatatggtgatatttgggttaattgtcatctgtaatcctccattcgtggtggaagctgccgggccggtcgttgcgctcgtaggtgtgcgcgccgaagcagtcccgctgggcctggattaagttggcgccggaggcgggggagcggaaggcgtccaaataggaagcggcctgggacagggcgggaacgggcaggccgtttaacacgcccgtggagacggcgcagcgcaggctgtcctggtactcgttgatccggttccggaagaaggggttaaacatcagattcccggcgtttgaatcagcctcataggcctttgtgatgtctccaaggaacacggcctggatgatacatccggcccggaagatggaggcgatcgttccaagatccaggttccagccgtagcgctccgaggcgtcctgcatcagggagaagccctgggcgtaggcgatgatttttccggcgtacagggcgcggcgcacagtctctgcgaaggccgcgcggtcgtcagcctgcaggattccgggaccttcgatctgcgccgaggccattttccgctcatccaggtggttggagaggatgcgggcgccgcaggccgaggtgatcatggaaatgtccacgccctgcttcagggattcgatgctggcccagcgcccggtgcccttctgccttgcgctgtccagaattcggtcgatgagctgcccgccgtccagatcgtcggcttcccggaagattccggcggtgatgccgatcagatagctctttaattcgccctgattccattcccggaaaatgtcagcaagctcaaagttggaaaaattccccacatatttcagaagcaggtaggcttctgcgatgagctgcatatccgcgtactcgatgccgttgtggaccattttgacgtaatgccccgcgccgtccgggccgatataggcgcagcagggttcacccatggccttggccgcgatggcttccagaatggggcggacggcctgataggcgctctcctcgccgccgggcatgatggaggggccgaaccgggctccctcctcgcccccggagatgcccacgcccaggtagtggatgcccgcttcggccagagcgttggagcgcctgcgggtgtcctcaaagaaggagtttccgccgtccatgacgatatcgccctgttccagcaggggaaccagctgatcgatgaccgcgtccaccggcgctccggcctggatcatcagcatgacctttctgggacgctccagagaatttacaaattcctccagggaataaaaggggaatagatttttgtggggatggtcctccatgacctgttcggtcacggaggcgctgcggttgtagccgctgaccttaaagccgtggtccgccatgttcagggccaggctgcggcccatgacggagaggccgatgattccaatgtgggatttctgtgatgtgttcatatggggatgctcctttcctataggtggaatccgcggggaggaggcttagggagggaaaagcccgggagggggaaacctgggatatggttcgggcgtttgcctgatccgattcctccggcggatgattctgtgattgtggttgttgtactgcgccggctgcactgcctcatctgtcctgcgccagcacaacagacacagcttccggcgccggcacgctggaacagagcgcgccgatcttcccgctttccgggtccaggcggaagcaggccaggccgcccttggtacggtttgccgccagcagatagttcccgtccggcgtcagaatgaaatcccgggggtggacgccgccgctactcacctgttggatggacgttgcctgaaatccgtccagggcgaacacggtgatcacgtccgcaaagcgtgtggaaacgtacaggaaccgctcgtctgcggacaggcggatggccgcggaagcgggtgccgggtccgaggtgaagttctgcgggagtatgggggttctgccgcgcagccggacggacgcggggtccgtccattcatagacaaacagttcgttgctcagctcgctgaccaaaaacagccgtctgcctgcgccatcgaagacgccgtggcgggggccggtgcccggttcaaacgggatggtcccaacgtgtgtgaagtcatggcttcggtcgtagatgttcacccgatccagcagcaggcagggaaccaacatataatcgccggtcaacaggacctgatgacagcccgccccgggcgcgatggagattgtccgcgccagccggggcgttttgtctgatttatcataaaccagcacattgccctcgtggtagttggcggtgtagatataccgctcatcctgagtcacgaagcaggccggggattgttccggcaggcattcacccaggggggaatcgccgggtgaagccgtatcgagcaggctgatcccggcccgcccgtccctgcggacaggcgcggccagaacgccgtcaaaaagggagagatacttggagtccgggaccgcaaagcggcgctgcggcgcggacaggcggcccgtctccaaatccagagaaaaacaatcgatacccggactggccggggattcgtaagttccgatatatccaatcagtttttgcataggcgatcctttcaggacaaactgtaattaaaaaagttacatttaataaatgtaattatagttgttacagtttgaaaagtcaaggtttttttataagttaaaaaaataccgcatggacatccgcgattttgcggcagtccgggcggatacgggacatgaccgccgctgccggaggaatttgccgttgacgggattaggatttgcattttaaggggattttattgatggaattaaaacaacttacaaaacaatcgcctgcaggctgcgccggcggcccattgcattcaatgtaaaagcggggcggtggcacctgttaagtgtcactgccccgcagcctgaaacgatatagaatcgattgtatcctaagcccaacccattgtggccaacacggtgatgaagataatcgcgattaccgccagaatgcccatcagcggaatggcatattttaaccaggcggtgtaatccacatcggccagctccagagcgcccaccatgggaccggacatcggagtcatggtgttggtcaggctgtcgcccatggagtaagcgaataccaccatctggcggctcaaaccgcagacgtccccgatgggggtcagcagcggcatcatgatcgccgccttggacagaccgctggggatgaacaggttcagcacgagcgtaaagatgaaaatgccgatggctgccagcgccaggccattgctgccgatcaggttggaggccgtgttggagatggtgtgcatgatgtggccctggtttaacaccattccgaccacgcgggcaaggcccataaccacgcagataccgcccatggactgcgcgcccttaaagaaggttttgctgatccggttcgggctcacacggtacaggatgctggcgaacacggagctcagtatcatgaacacgtacaggtattcctggccccagccaagctttggagcgcagacggcgtataagatatacacggcaaacatcacaaccacagcgataatgccttttacaggcagcgcaaccgccttgatatcctccatgcccggctcgggagacagaacctcccccatatagcttttgctgggatccttggaaatccggatggcgtatctggtgcagtacgcggcgttgacaatggtgaacacggtccacacgatgagacgggctcccatgccggacagcggttccacgccggccattacctggaactggatcagcatgttggaggtgaagcttgcgccctggccgatcaggtagcccaggtagaacatgcccatggccgtgatccggtctaaacagagccgcgaacagatgaccaggcccacggtgacaaacgcgatcatggaatcgtttccggcaaaggcgcccagggcggacatcatcaccacgatcgcgggaaccagcaccttggtgctcttgtcctgcagcctgtaaactccaaagttcagcacatcgttaaatgcgcccgtatccagcagcacggcaatggagccgccggccaccagcatcaggctgatcacggaagccgcgctttcaattccctttttgatcatcagcagagcggcccacggcgatacgggttcgcgctccaccacgtggtagcttccggcaatggcctggccggcctcgttcatgtcatagacgccgggagttgcgatgtaggttgccagacaggcaaacagaatgatgaacaggataatgataaagatgtgcggcacattgagcttttttactttttttgtaggttccattcgattccctcctggtagttgttttataagattcccagcaccactgcgaagagagctgtcttttcctcaaaggaggagaggcgcatggattcgtcggtggaatgaattttatacatgtaggggccgagggcatccactgccggcacgccgcgatagctgaaatagctggcatcgccgctgccgccgctggcctgctccggcaggtccttgcccaaaaggagcccggctttgtgaacggtctcgtagagctgaacgtttttctcattgcgctccatgggaacagagatgcggtcgatgcggatttccgtctttgtcccctcaatgtaggtttccttttccacccgggcgatgatttccttcaccttgtcgatgtccgcctggcaggccacccggacgcccacctttgcggtggcgtggtcggacacaattccggtgccgtagtcgccgccgtacagcgcagccgggttgaattggattccccgcacattgtcgttgttttcgtacagccgcaccagcatgtggcccagctcaaccgtggcgcttctgccatccaggtaattgaccccggaatgggcttttttgccaaatacctccaccgtgatactgcacgcgccctttctggccgtgagaacgccgtcctcgtctctggagggctcgaaaacaaaggccatctccgcgccggggatctccgtgtcgaacaccgcgtggccggtgggggttccggtctcctcatcgcagttaaagataaagacgatctccttgttcggcagcatatccgcttcctgcataatccttaccgcatggatcgccaccaggattccgcccttgcagtccacgatccccaggccgtaagccgtatccccgtcctcgtgatacggataagccgctgtgtcgccccggtggaaaaccgtgtccgtatgcgcgctcaaaagaattttgccctcaggcttttccggcttcagccgggcgacaatgtggatgccgtagccctcggcgtagtggtgggtgatctcaattcctttgatcagcttcagctgccggtcgatgatctccacgaccctggcatttccctcctcgtccccggtgccgcagtcgatggcggcaaattgttttataatctcaatctgctgacgctgcgcctcggctgcccctttgcgtgcggcggccactacctgctccggatctcttctgttctggctcatgtttcactcctcctgtctcgttgatattttattaatccgtcaatttctgcggagaaatattcgctgtcgttgtatattttatccatatatggtatattgctattatacttcattgtagatattgatcaactttttaaatgttataatcgaattcaaattataactttttgttattgtaaaagatgagctgccacggcttcttttcagcgtggcggacacctggaacgacaatgatttgggagatgggcgaatgtacctgaaagaacagatttacgttttagagatttacaagcagcagtccttgtccaaggcggcgcaacgcctccatatcagccagccggcgttgagcaactacctgaatcatctggagcaaaatctgggaattgcgctgtttgtccgtgaaaagcgtcgtcttgtgcccactgaggcgggaaccatatacattgatatcgccgcccggatggtgcggttgcaggagacgttttaccttcggttaaaacccctcctggaaactgcgccctgcgtgctcagaatcggcatccaacggatccggggagccagcatgattcctaagattctgcagttttttgcggaacggtatcctgagattaaagtggagtttctgaaaggcagttttatggagctgctgtccggtttggaatcggacgatctggatctcctgtttgggtaccatattccctccctctatcccgcctccagatataaaaattattccattgccagggatacactttatctggcggtttccgaaaaccgcagagactcaattccttcagatttcagccgtctgagcgatgcaaccttcatcctgcatcccaacacgcagagcgaacgttttttggagaatgaatttctaaaagagaaccacattgtaccggaaaagattatagaagaggacaccatggaagtgattttgcgcatggctaccatgaatatggggatatgcttgattgcgggcagctatatcaagtattacagggctccgggaatttacttctaccctacggactgccgctacaaaaccctggacttctgtatgttcactaagaaaatgcaagctgcgcccaagtacctggaagaactggccgcctttaccagaaacattttttagaatgaggaaatgaaaaagagcagccagctaaaatgcgtggccgctcttctttcggttcttatgccaaaacgctcttcaaatactccgcaatctccggcacctggcagttggggaagaagtattcctggaacttctcgccgctgatggcggtttttaagaagtcctggtcaatggtttttaagatggtcatgatgtccttatgggtgatttccttcacgccgtccagaatcttcttgttgcgctgctccggcaccacccgctccttgggatagcccccgccgctctcgcagccgaaaagcttctcaaaaatgtactgaagccgcagctccgcgccccagccgaagcccttggcaaagggcagggcgatggcgttgccgtcgttgatctgcgcgaacatgtaggcgtcctcgctgtccacgatgtgtccgcagagcacgcccgggaacacgttgcaggccagcattgcgccctcgcctgtgccgcagccggtaaccacgtagtccgcggccttggagttgagcaggatggcggccagcaggccgttcatcacgtaggtcagctgagtctcgtcctcggcggtgtacataccgtagttgtaaaccgtgtggcccatgggctccacgacctttttcaagttgtcgcagatcatttcattcttggcggcctggctgttttcgttgattaatgcgattttcatatgaacattctccttataattgattgaataaaatagttgcgtttatttaacaagtatagagggcaggtaggtgacgattccggggatgtaggtgcacatgagcagcaccacaaccagggggatcaggaagggcaggatggacttgtagagtttgtccagcttgatcttcgccacgtcggagatcacgaacaggcacacgccgaagggcggggttacctggccgatcatcaggtttaagaccatgaccacgccgaaatgcaccaggtcgatgttcaggctcttgataatgggcagaagcaccggcagcatcagggtcaggattgcgcccggttccataaacatgcccagaatcagcaataccacgttgatgattaacaggatcaccgccggattctggctgattcccagaataaagttggcgatggcggtggaagcgccctccttcaccagcacgtatgtaaacagggtggaggtgccgatgataaacagtgtgttggccgaggtgatggcggattccagcaggcagtgcttgaaggttttccagtccatggtgcggtaaacgatcagcgcgatgatcagggagtaggccactgcgatgctggaggcctctgtgggggtgaaccagccggttgtaaagccggccagaatgatgagcggcgtgatcagggacagaatggagccgaaaaactgacggatcagggccgccacgtggaagggatggcgctcaaacttgtatttgatggcaaagagaaataccagaaccatcagggccacgcccattaacagtccgggcagcacgccgcccatgaacagcttggctacgctgacgctggccgtggcgccgtaaatgatcaggggaatgctgggcgggaaaatggggccgatcaccgaggaggccgccgtcacagcgccggaaaagtcgtcgtcatagccgtttttggtcatggcctccatctcgatggtgccaaggccgccggcatccgccgccgcgctgccggacatgcccgcgaaaatgatgctggctacgatgttggcgtgtcccagaccgccgggaatccagcccaccagctccttggcgaagctgaagatcttgtccgtaatcttgcctgcgttcatcaggttaccggccaggatgaacagcgggatggcgatgagcaggtaggagtcgatgccggtgaccattttctggccgatgaccatcatggggtagtctaaaaccaggcagcccagaaccgcgctggcgccgatggagatactgatcggaacgccgatcagcagcaatataacgaaggtgataaaaaatattgccatacttggggtcctcctttaatgtactgccttgccgcgcagcgtctgaatccggtcaagaacctggtagacggtctttacgacaatgaatccgcccgcgatagccatgggaaggaaatgccaggctttggacagaaactgcatggtggagaagtagctggtgctgttgatcttgtacatgcctttgtaagcgacgatcatgatgatgcccaggccgaagctgaacagcttgttgatgaaccagaaggtggtctgtaccttgggattggcccgcacgtacagcatgtccagggtgatcagccggtccttgtcgtagagcaccacgacgcccagaaacgccatccacatgaacaggaagccgcacaactcggtggaggagcggaaggacttgttgaagaaattgcgcaggcacagctcgtagagcatgatgcccacaataccggccaccaggaccatcagggcggcggatacgatttttacaaagatgtcggtgatttgcttataaactttcacggtatcactcccttatcgtttagaggggctgcaatcccggcgggaatgcagccccctgcttgaagagtctctttattttgctaagatttcgtccaggatctcctggttgtaccaaggctcgtctttgtagcgtaagtagtagtcgtttccgcccagcttgtcgatgaagctctggatgtccgggttctcgtcgaactcaacgcctgcggccttcagggtctcggtagcggcctggttgtccttggcgatggtgtcgaaggaatacttcgcggcagccttggcctgctcttttaagatctcctgatactcagccggaagcttgtcccaggaatcggagttggcggccatggtgcagcccatccacatgtagttgataaagctgaaatacttgatatcgtcgtaagtggcgttggctaccaggtggtaggtggcgttgtcctggccctcagcggtgccgttggacagggcgattgccagctcgttcagcgccagggctacggggttggcgcccagggcctcccagcagtccaggtacatctggctggtgggaacgcgcagctttaagccttccacgtcggccgccgtatgtacgggacggttggtggtggagatgtggcgcatgccgttgtcgccttccgccagatagatcagcccggtggagggcaggtctgcaaagatcttctcgccgatctcgccgtttacaacctcgtaagcctgctcagcgctgtcgaacaggaacggcaggtccaggatcttcgccttgtcgtagaactctgtgaaaccggaggttccggcaaagatgatgtcgatggttcccatacgggcggactgaagagcttcggcgtcgtttccaagctcgccggagtggtgggcgtccagagtgatcttgccgccggaagcctcctcaaccagcttcttgtattccagaatggtcttggtgggaacggaattctcgttgcccggggagtagatggtcagcgttacggggtccagcgcgtccagtgcggaagcggcggcctcggtgccagcctcggaagcggcctcagagccagcttcggaagcggcttcgctggcggcctcggtagccgcgggagcgggagcagcggtagtttctgttttgccggatccgccgcaggctgccagggacagtaccatggaagcggacagtgccagtgataacatttttttcattttttaccctcctgagtgacgttacatttgcgatattgtatgattgtatgacgtcttgcgttaacacaattataacattttgagccgcaatgtctatgcacgaatggtataaaaaagttgtgaagattttgtgaagattgcataaaaaggctggaggttatttgtggaagatgggagaagaatgggggagaaaggtggcaaaaaaatcctgattacaacgttttgaataataattgcaggaagtatcgcatatcgggttgtagaattttttgaattggcatgggacgcagctgcggctgcggaggaacataaaggggatggagttggggataaaggtctgaaaaaaagcggacgccgtggatggctgtccgcttttggaatgtttttacctacgccagaagactctttaaatactccgcgatctccggcacctgacagttggggaagaaatactcctggaatttctcgccgctgatggcggtctttaagaagtcctggtcaatggtttttaagatggtcatgatgtccttatgggtgatttccttcacgccgtccagaatctttttgttgcgctgctccggcaccacccgctctctgggatagcccccgccgctctcacagccgaaaagcttctcaaaaatgtactgaagccgcagctccgcaccccagccgaagcccttggcaaagggcagggcgatggcgttgccgtcgttgatctgtgcgaacatgtaggcgtcctcgctgtccacgatgtgtccgcagagcacgcccgggaacacgttgcaggccagcattgcgccctcgccggtgccgcagccggtaaccacgtagtccgcggccttggagttgagcaggatggcggccagcaggccgttcatcacgtaagtcagctgagtcgcgtcctcggcggtgtacatgccgtagttgtaaaccgtgtggcccatgggctccacgaccttttttaagttgccgcagatcatttcgttcttggcggcctggctgttttcattgattaatgcgattttcatacgattacgctccttaaagtttaagatcaaaatatcattttaccagcatgttgggcagccatgtgacaataccgggaatgtaggtgcacatgagcagcaccacgaccagaggaatcaaaaacggcaggatggatttgtacagccggtccagcttgattttggccacgtcggagatgataaacaggcagacgccgaagggaggggtcacttggccgatcatcaggtttaagaccatgaccacgccgaagtgcaccaggtcgatgtttaagtccttgacaatgggcaggagaaccggcagcatcagggtcaggatcgcgccgggttccatgaacatgcccagaatcagcagcactacgtttatgatcagcaggattacagccggattctggctgattcccagaataaagctggcaatttcggcagaggccccttctttcaccagcacgtatgtaaacagcgtggaggtgccgatgataaacagagtgttggccgaggtgatggccgattccagcaggcagtccgtgaaggttttccagtccatggtgcggtagacgatcagcgctatgatcagggagtaggccaccgcgatgctggaagcctcggtaggagtgaaccagccggtggtgaatcccgccagaatgatgagcggcgtgatcagggacagaatggaaccgaaaaactgccggaccagggccgccatccggaagggatgacgctcaaacttatatttgatggcaaagagaaataccagaaccatcagggccacgcccattaacagtccgggcagcacgccgcccatgaacagcttggccacgctgacgctggccgtggcgccgtaaatgatcagggggatgctgggcgggaaaatggggccgatgaccgaggaggccgccgtcacagcgccggaaaaatcttcgtcatagccgtttttcgtcatggcctccatctcgatggtaccaaggccgccggcatccgccgcagcgctgccggacatgcccgcaaaaataatactggccacaacgttcgcgtgccccaggccgccgggaatccagcccaccagctccttggcaaagctgaagattttgtccgtgatcttgcctgcgttcatcaggttgccggccaggatgaacagcgggatggcgatcagtagataggagtcgattccggtaaccattttctggccgatgaccatcatggggtagtctaaaaccaggcagcccagcacggcgctggcgccgatggaaatactgatcgggacgccgaccagcagaagaatcacaaaagtgatgaaaaagattgccattgtacagttcctcccttagtttgtgttggttccgtgtgggactacaatccgatccataagctggtagacggtcttaacgacgataaagccgcccgcgatggccatgggcaggaaatgccaggctttggacacaaactgcatggttgaaaagtagctggtgctgttgattttgtacataccctgataggcgacgatcataatgattcccaatcccaggctgaaaattttgttgatcatccaaaatgtggtctgaacctttggggtggcgcgcacgtacagcatgtccagagtgatcagacggtcctgatcgtacagcacgatcacgcccaaaaacgccatccacataaacagaaagccgcacagttccgtagaggcgcggaaggatttgtttaaaaagttgcgcaggctcagttcatagagcatgacgcctacaaggctcgcgataaggcacattaggatgacagacacaatcttcacaaaaatatctgtgatttgtttgtagattttcactgtattctccccctattctttagggggctgcaatcccggcgggaatgcagccctctttggctgatggtttgtatccgttcaataccctcacagatacgatggtttcttattttgctaagatttcgtccagaatttcctggctgtaccacggttcattttcgtagcgcaggtaataatcgtttccgcccagcttgtccttaaaactctggatatccgggttctcatcaaattccacacccgcggccttcagcgtctcggtagccgcctggttgtcctcggcgatggtatcgaaggaatatttggcggcaatttttgcctggtctttcaggatcgcctgatactcggcgggaagcttctcccaggattctgcattggcggccatggtgcagcccatccacatgtagttgataaagctaaagtatttgatgtcgtcgtaggtggcgttggcaaccagatggtaggtggcgttatcctgcccttctgcggtgccgttggacagtgcgatggccagttcgttcagggccagggcgaccgggttggcgcccagggcttcccagcagtccagatacatctggctggtgggtacgcgcagctttaacccctccacatcggcggccgtatgaacggcgcggttggtggtggaaatttggcgcataccgttgtcgccctcggagagatagatcagtccggaggagggcagatccgcgaagatcttttcgccgatctcaccgtttactacctcgtaagcctgctcggcgctgtcaaacaggaagggcagatccaaaattttcgccttatcgtaaaactccgtaaaaccggaggtccctgcaaagataatgtcgatggttcccatacgcgcagactgaagggcctcggcatcgttgcccagttctccggaatggtgggcatccagggtgatcttgccgccggaagcttcctcgaccagctttttgtactccagaatcgtcttggtgggcacggaattctcgttgcccggcgaatagatggtcagtgtgaccgggtccagggcgtccaaaccggagacagctgtctgggaaccggtctcaccggcgctctcatcctgggctgcggcagttgcagccggtgtggtgggagctgcagcggttgtctccgttttccctgagccgccgcaggccgccagggacaataccatagaggcggacagtaccatcgataacatttttttcattttctttctcctcctgtttcatcatatgtgcagcgattgccatattgtatgattgtatgatgtcttaatgcgttacaggtattataacattttgaccttgaatgtccatgcacgaaaattataaaaattttgggcagtatgcacaaaaactacgcctataatttgtgaggtattaagaaaacgttaaaattttaaggcaaaaaatatcccgtacattactttttgacaaataatgtacgggatttttgttaccttattgtggatttttccagatcctttaccacgagatttaaatgttcttccatgctgcgctcgcctgccgccgcatcccgccgcttgaaggcgtccaggatattctggtgaggctcgatggcgttggccgcgttctgcgggatgtagaaggtcttgcttcggaagttctttacatgcttttccacctgtttgctgatgctgatcagcagctggttgcggctgaactccacgatggcggagtggaacttctcgtcgttgatgctgatagccggaacgtcgtggctgttgaccgcggcggtaaattttctgtggatgtgttccagctgcgccacgtcctcgtcggaacagcgctcgatggccaggcgaacggacagcggttcaatggccatgcggacctccagaaagtccttggtctccacctcgtgctcggtgaaccactgcatgacgtcgcccaactcgatctcggacgttctggcggcaaacgcgcccttgcccggtctcagctccacataaccggtggcttccaatatgcggaacgcctcccgcacggtgcctcttcccacacccaactgttcacagagctctttttccaccggcagtttgtcgcccactgcgatttcgccggaaaacagatattcctttaacttgtccacaacctgttggacgatgggcatccgctttactgactccatgggaatccccctttatacatactcgcaatttgtcataccaatcatgttttttatcctaataccaaagcagatttttgtcaacctgcaataaagttttctttttatggggattgatcattgacatttgcacaatgctctgctatcctgtgatcagattgtattattgtatgatgacaatggaaacacaaaatcttagctgaccataatggaggaatcatgatggaaattgcaagtctggaaaaagtctgccgcaccgtgcgccgtgatattatcaatatgaccgccgacgcggcatccggccatccgggcggctcactgtccgccgtggagattatcacaacgttgtttttcgacaaaatgaacattgacccgcagaatccgaagaaggcggaccgggaccgtttcgtgctgtccaaaggccacgcagcaccttgctactacgcggtgttaggcgagcggggatttttcgacaaggcggaatttaagaacttccgccagcttcacagctttctccagggccacccggacgctaagaaatgcccgggcgttgacgcctccaccggctccctgggacagggcatctccattgcagtggggatggctcttggcgcgaaaaaactggatcacagcgatgtgaaggtatacacgcttctgggagacggcgagctccaggagggccaggtttgggaggcttccatggcggcggcccactacggcctggataatctgaccgtgattatcgataacaacgggctgcagatcgacggcaccaacaaccaggttatgagcctgggcgacttaaaggccaagttcatagcattcggtttccaggttctggaaatcgatggaaatgatctgggccaggtgtcggaagcccttgacgcggcggcggaggatggcaagcccaaatgcatcatcgcccacacggtaaagggcaagggcgtgtcctttatggagaatcaggtgggatggcacggcaaagctcccagcgaggaggagcgccgtcaggcattaaaggaattggaggaagagtcatgagcgaactgaaagcaatccgcgtcgcctacggtgaggcgctggcggaactgggagagaagaatcagaaggtggtggtgctggacgcggatctggcccacgctaccatgacagcgacatttgcagacaaattcccggagcgtttcttcaacgcgggtatcgcggaggccaacatggtggacatggcggccggcctgtccactatgggatacgttccctttgccagcacctttgcggtgttcggcgcgggccgggcttacgatcaggtgagaaacggctgtgcgtacccgaatttcaacgtgaaattcggcatgacccacgcgggcgtcaccctgggcgaggatggcggaagccaccaggccatcgaggatctggcgctcatgcgtgtgatcccgggcatgaccgtggtggtgccctgtgacgccagcgagacccgccgggccgtgatggctctggccgatatgcagggacccgcttacctgcgcctggcccgcctgccctccccggtgttcgaggaggagatgccctttgagattggaaaggccaacgtgctgcgggatggaagtggcgtggcggtgttcgcctgcggaattatggtgaacacggcgctggagtgcgcgaaaaagctggaggccgagggtatttccgttgccgtgatcaacatacacaccatcaagcccattgaccgcgactgcattttaaaatacgcggccaagtgcgggaagatcgtgaccgtggaggagcacagcgtgatcggcgggctgggcgacgccgtgggcagcgtgcttctggaaaacggctgtccggtgaaattccgtaagatcggcgtccaggaccgcttcggccagtccggcaagcccgccgacctgctggaagagtacggactgagcgagggacaggtgtaccgtcagattaaggaaatgaccgagtagtattcggggaatatggagtgtaacgaagctggaataagctgaactgtgaaaacagccgcagagctgccgcggaatgcggcaaatctgcggcttttggcgtttggagaataagaagggcttgtttcaaaacgccccatgctttataataaacacggacataccgcgcacgtgacagccgtgacaggccgtgcggggccgcggcagactataatataaggataaagggagattgtgtcatgaagattgcgatgggcaatgatcacacaggaattgaactgaaaaatatcatcaaagagtttgtggaaggcaagggttacgaggtgattgacctgggaaccaacgcgccggagagctgcgattatccggtttacggtgagaaggtgggccgggccgtggcggacggggaagcggatctgggcatcgccatctgcggaaccggagtgggaatttccctggcctgcaacaaggtaaagggcatccgcgcctgcgtttgcagcgagccctacaccgccaagctttccaggcagcataacaattccaacgttcttgccttcggctcccgcgtggtgggcagcgagcttgccaagatgatcaccgaggcctggctggacgccgcgttcgagggcggacgccatcagcgccgcgtggatatggtgatggagattgaaaagcgctgatcgtgcggaaaccgtttatatgagcgggggagaccgcgcgggaaccgccggccgggcggggaggcgatccagcagccgccgatgcggcggcgccttaaaaatattaagaaagaggggaaggcatacatgaaaaagattggatttatcggcatcggcattatggggaaatccatggtcagaaacctgatgaaagcgggatatgaggtggcggtttacaaccgtaccaagtccaaggtggaggatgttgtggcggagggcgcgctgtggtgcgacaccgtggcccagtgcgcggccggacgggacgtggtgatttccatcgtgggatatcccaaggacgtggaggaagtctattttggcgagggcggcgtcattgcccacgcggacccgggaacctgcgtcatcgacatgaccaccaccagccccaagctggcggtccgtatctacgagaacgcccgcaaaaagggcttaaaggcgctggacgccccggtaaccggcggggataccggagccaaagcgggcaccctgaccattctggtgggaggcgaccaggaggcatttgagacctgtctgccggtgtttgaagccatgggtaaaaatatccgctacgagggtaaggcgggcaacgggcagcacaccaagatgtgcaaccagatcgccatcgccggtgcgctcagcggcgcctgcgaagccatcgcctacgccaaggccgtgggtctggatccccaggtgatgctggactccatcagcaccggagcggcgggcagcacccagctgagcaacgttgcctccagaattctcaaggacgattacgaccccgggttcttcatcaagcacttcatcaaagatatgaagctggcttccgaggaggccgaggctgccggcgcaaagctgggcgtgctggactatgtgctggacatgtaccgggatctggaaacggaaggacttggagacttaggaacacaggcgctgattaagtattacgagaaataaactgcaagacaggaaaacgcggaaaagcagctttgccggcggcaaaatagccacagacaaaactgcttttctgaaactcagggggatgaagcatgatcccgcccattgggaatggaggtcaagagatgaacgatccattacaatttgaaacccgcagcgaattccgcgcctggctgtccgcaaattgcgcgtccagcggcggcgtctggctgctgtttggcaagacggaggaaatcaagacgctcaaagccggcgaggctctggaggaagcgctctgcttcggatggatcgacggggtgatgaagcggattgacgatcagtcttacaagaaatacttctccgcgcgcagagccggcagcaagtggtcggaaaagaacaaagcgctgacggagaagctggaacaaagcggccggatgacggatttcggcagggagaaaattcaggaggccaagaaaaacggccagtgggacaaccccgccggttccccggccgtgacgccggagcagattgaagccgtagccgctctcctgagcggaaatgaacaggcccacgccaattttcttgcgatgccgccctctgttcggaaaacctacgccagggcgtattttgacgccaagaccgaggcggggcgtgcaaaacgcctggcctggatgacggaccggctggagaaaaatcaaaagcccatgtgatgaaggcgggagcctaccactcccgggcaaccttttccgacagccgttcctgcacaatcccgcgcatctggtctgcgctgtaaagtacctcgatgtccatcttccatccggtgcccctcagatcattgtgggggatgaagccaaagtcgtaggtttccccgccgctgtttattttgtagatcgccgcttcagtttttcctcggaaacgagtaaatgaaggattttttctaatagcatggctgcgccccttaagcgccagtttcagaatcacgtttcaggcttctttttccacgcctttaagcaggcatttccaatcactgccagtccgataagaataaaaacgcaggacaccgggcgtttaaagaagattgtcatgctgccgtggctgagctttaaggcccggcggaattcaccctcgaacatggagcccagtaccaggcccagcacgatgggagcggtgggaaagccgccgcggatcatgagatagccgaacaatccgatcgccagagtcaaaatcacgtcgaagaaattacttctcagcgcaaaagaacccaccagggagaggattaccagcgccgcgtttaagtagtgcaccggtacgttgagaatgcgcacaaacagtttgattccaacgcactggatcagcaccataaggattgtggccatgaggacggttgcgaagatttccgataccacctggggggagtccgcaaacagagccggaccgggccgcaggccgtgaatgatcagtccgcccatgagtgcggcggttacgctgtcgccggggattccaagggtcatcatggggatcagggcgccgccgcagacgccgttgttggccgcttccgaggcgattactccctcgtaggctccgtttccaaactcatccggatgctttgaaaagcgttttgtctggtcataggcgataaaagaggcgatattcccgccggttgcggggatgatcccgatgcccgttccgattatgctggaacggataatattccatttctgctcccatatctttttaaaactgggaagaaaatttttgagctttaattcccgggcgtccacatgcggattccctttccccgtgcagctgatgataatctgcgggattgaataaagaccgatcatggcgggaatggtgctgactcccgtcatcaggttgatattgccgaaggtgaagcgcaggtcgccccaaatcggatccgtgcccacaaaggagagaatcacgcccacgattccggcgatcagccctttgatcagggatttgcctgacacggccgcgatgatggtcagtccgaaaaatgccagggcggcatactccggcggtccgaagctggtacacagcccggccaggaccggggagagcgtcaccagcagaaaccagctcacaatactgccgaagccggaggcgaaagccgcccagcccagcgcctcggcgccccggccctgtttggccatgggatagccgtccaggcaggtaacaaccgcagagggagtgccggggatatttaacagcgtagcggatacggcgcccccggccattcctccgatataggtgcccagcatcatgccgaatgcgctggtggtgtccatggtaaaggtcagcgggatcaataacgccacgcccatggtggcggacagtcccggcagcgctccgaacaccagacccaggaaggttccggcggcgacgatcagcagaatcatcggattaaaaaatgtggcggccgagctttgaaacatcataagaattgtgtccataggtccctcctgttatccgatgacaagttccagcagcggctccggaaagtccactccgaaggccatgccgaaaataatgtagattgccagggtgacaaaggctgatataagaaccgccctcagcctgggcgtgtcgcgtttcagcaaaatggattccgcaaagaaaaacagaaagctgctgatacagaatcctagaattctccagaaaaatgcatagatcacgattgccgccatggtcaggacggtccgtggatcacgcttcccggcggagggatgatccgccgcttgtgaccccggagccggtttgtccgcctgaacaggcgcggtccggcctccgttctgttttaactgcaccgccaggccggccatcagctttccggcgcagaataccatcagcaccagaaggatgcccttggggaaatccatggatgccatgtctgcgcctgtagctacggatttcgacaggccggcggtgtagtaaaggaacgcggcgcccgtcaggagcagaagtaacacaatccgttcaaaaaaacgttcctcttttttcatgtgtctcctccatccggccggttactgcgcccagatctctttgctggcattttcaagtccgccgtacacgtcgtccaggaacacgtccagttcctcgccggtgatcggctgggacaccaggccgctttcctcggcaaaggccttgaaatcgtcgctttccagcgcttccttgaacatggaggccagtttttctttagctccggcatccaggcccgcaggggccataatataggaggcctggcggatatctcccagcgtaaacacgtcgtatcccagagattcaaaggtgggaacattcggcatggcggcgagcccgtccttgttgaaaacgcccagcaccacgaggtcgttggatttcacctgagcgatcacctcgctgggctttaaaacgcccgcgtccacatgtccgcccaggatttccgtgatcacccgggaaccgccgtcaaaaggcatgaataaaaagtccgtgcccgcagcctgacctaaaagtgtggcgtaggcctggtttacgttattggatccggggatgccgacggagatttccccggggcttgctttggctgcgtcgatcaggctctgggcgtcggcgtattttccgccgctctttgccaccagcaccaccggttcctcggctaccaggcagatattctccaccttgtccagatccgcctccgccttaccctgggcaaccagcgccaggaaggagctggaggcaaggcccacggtgtagccgtccggcttggcggtgagaacttccgtgattcccacggcgctgccgccgccgggagagtttttcacgaccagctccacattgaatttctccttgaaaacgggctgcagcgcacgggccatcagatcgttggtcccgcctggattccagggcaccaccaccgtaatctctttattgggaaattccttttttccgcctgcgcatccggtcagaagacccgcagccagcaccacgctcagcacaccgtataacaatctgttccgcataaactcttcctccaatcatatcgtctgaattgtctttcggatattggagatatgctctttcatcgctgccgccgcctgctcttcatcgcgtgctttcagtgccttcagaatcttcttcatctcgccctgggtagggacctgacggtccgcccaagtcatgttgacccgctggatccgctggatttccggcatgtaccgctgcatgatttccgcaatgatcacgttgccgctggcgcggtagatttcattgtggagcgctacatccgcgtcgtagatgaactggcgtttttccgccttttcatcccggaacgcatccatttggtcaaacaggtcctgaagcttgtccagctgttcctccgtcatggagacaaccgctctgcggaccgcttcaacttccagaatttccctgatatcacagatacttctggcacgttccacggaaatcttactcacgaatgtgccgtactgtggtttaatgctgacgaatccttctttttccagtttcgccagcgcacttttgatgggagcccggctcacatccagggcagctgccagctgcgtctcggatatcttctcgccgggggcgtatgttagctgaacaataccttccaatatcttatcgtaaacataatcgctgattgtctttttctccaacatggatcgtttctcctacttattattttataataacaactttatcatatcggattttattccacaagcgattatgcccttgatttggttacataccgagttcctgccagatctccagcagccggttatattttacgttacgctccatccgtaccggagatccgagcttgatttgacgggcgcccacggccaccgccagatccgcgataaagtcgtccgcggtttctcccgagcggagggagacgatgacgtccatcccgttttccgaagcggtccgggcggttttgatggcttccgtcaccgtgccgatctggttgattttcaggagaaccgcatttgcactgcggcgctcgatccctctgcgcaaacgctccggattggttgcaaacagatcgtcccccacaatctgcacaccgggaagtgcgccggacagctctgcaaacccgttgaaatcatcctgatccagcccgtcctcaatcagagtcaggggaaattcgccgcacagaccgcggtagtaggagatcatttgggaagtgctgagatagcggtcctctcccatccgatatacgccccggtcaggctcccacagctcgctggccgccacatccagtcccaggctgacgtttccggcatatcccaggctccgggcggtgtccagaatccagcggaaggcttcacgggaggaagcgcagggtgcggccagagcgcctccgtcctccgggaaatccccataacatccccgcagcgctttttccagggaaaagcgcagctcgcagagggcgtccaactcctccggaaaggaggaaaatccgtgaaagaccgccatgtaatcctcaaactccatccctgaggtggagaatacgccgcccgcaatcaccgtggccaggatatccggcagcgcaggccggatgtctttttggcccagatagcggtagaccggttgatttgtggaagccgcgccagcctttgcggcggctactgaggcggccaaaagggcgtttccgccaagccggtgcttgtccggcgtgccgtccagacggcacagagtctggtcgatggcttcctggtccgccacgtccattccggccagcgcgcggcagatttccgtggagatattttccgccgctttcctggctccgcggccgttgtggcgggtttcgccgtcgtacagctcaaaggcctcgtactttccccgggacgtgccgctggggacggaagccgtgacgtggattccgcgctccgtgatcagttgggcttccacggtgggacggcccttggcgtttaggatttcccggcctttaattgccgcaatccgatccatttccctcctcctttccgattaaaacaatccgcaggttcataacattggttccggtgtgcccggtgatcaggtcgtcgcccagatgttccagcatttcacctgaattgtggtcgtgaagtaccttggccaggtgaattttctgctcccgtatccggcgcacggtggctccgtccacgattccgcccgcccggtcgcagggcccgtccgtaccgtctgtgtccaggctgataaaggcatagcccgcccgatggcggatcttccccgcaaagcccagaaccgtttcctgattcgggcctccgcttccgcagttctcctgaatggttacggtggtttctccccctgaaatcagtgcgcatggcggttggaaggggcggttggaggtgagaacctcgtcggtgatgcctgccatcacgatgccgacgtccttggcttcaccctccattgtggtagagatcacatggggcgtgtagcccagagcatgagccgactgggccgccgcctggcaggccagctggggatcggccacggaaaatactgcctgccgcattccgtccaggcttttgacggtttccagctccggatgttccagaccgtacaggaggtagctgcggaccggttttggagcctgctcccacagctcatagtccttcagcacctgaatggcatccgcgaaggtggtgggatccggcaggcacatatccggccacggcatatccggcggggccgtgtcaaaggtcagcgtcacgaccatggcgggctgtccgtactggaccaggcgtccgcccttcatcaggcagatgtgtttgcggaccatattgatcttgccgatctccgccccgcagttgagcagatccagattgatctgcctgagattttccagggtaatccccccggccggtttgttgacaagggcggaggaaccgccggtgacagcggcaaagaccaggtcgccctcgcccgcctctgacaggatgcgcatcagcttatccgctgcctcgatgctgcgggcatccgggatggggtggctggattcgaagatttcaatatgggggagacggcgtttttcgccgtcttttacaatgacggttccggctctgatgcgttccccgaagatttcgtccagagcctgggcgatgggaaaggaacccttccctgcgcccacgacgtaaatatgattcacgtggtcccagggaatttccagcccgcccacgcggatacaggaaccatcacaggagatcagcctgcggaccgcctcatagggaatcaccctgcggattccggcttccgcgatttccagcgcgtctgctctgagcttatgatcgccattggcaatgatgcgctcatagttggaaaatagcgtgctcatacgttggtctcgtcctcccttcccaacaagataccgtccgcgctgaagcgccagggtgaaccggcccaatcgccggaaatgtgttccatagcctgagcttcccgcacaagggcttcagaaatctccatttcatcgagccgcaacgtgtttttgatccgcacgatgcgcaggttttcataatctgcatccggtgcggttttgattccggcccgtatggtgtcaaaatcattgtccataatgatcggaattttgcagcccagagtcgttctggccgtcagaccgttgggataggtcttggacatagacattttttcgaaggctctccggcaggcgatgtcggccaggccgatgccggaggcatttccgtcggactcctctgtcaaatccagaaccaccagccgtttggtgaaaggccgggcggtcatgtgctcggaggtgaaacgctggacgatgttgcagtccatgccggtgccggtgatatttttcccgatttcatccaccacaaggaggtccagactgccgaacggaatgcggggaaggtaggtcttggccttctccagcagggccggttcctcccccaggatattgtccttcgggaaggcgcggatcatacaggtctggtcgtaggcattttccatcagccccaggcagaagagcaggttggaccgttccatgtggacgcgcccgattttttccagattgacgcccatgttcgccatgcctttgatgtggcagtagtccgcacctctctgcttgccaaggccgattacactcattttcaccatgccgctctcgtatttgccgcggaagctgctgtgcggtttgatccgggcgatgctgaccgtgaaatccgcacagttggcatagtggtcgaaatagacgggcacgccctccggcgtgtgcccgatgcagtcggtctccatagtggcgcggattggaatgcccatggcctgctcgctgatgcccagatgttccaggatgatcttctggttttgggcaatggctccgccgtggctgcccatggcgggtacgataaagagggaggccccgtgttcactgagaacgtcgatcacggtttttacaatctcaggtaaattcgcgatgccgcggcttcccaccgccagagccacctgtttgcctctcacgcggccgatgtccggaatttgagagatttcccgccggatggttccggcgatatccgtcacgcggtcgcgggcgaactcctgagaaacccgatacatgcggggaagccggacgctgtccagaatgtcgtcgtatgttcccatgttatcccctttctagttggatactagttgctaactactagtatactagcagagatcaaaccaaatttctaccggtaaaatcaactaatttaaccaatgtttttgtggaacatggacagggggagaagatgagaggagggggaagacaaaaaaaggctgccccgaactcacattcaggacagcctctaaaaggctttcaacccatatagatcttagtaattctcaaccttgcgctcaaaataagctttcggatgtgcgcagcaggggcaaacttccggggcttccggtccttcgtggatgtagccgcagtttctgcacttccagcccagaggggcgtcgtccttgaaggtcttgtcgttcttgtagctctccagcagctttaagtagcgtctctcatgagcagcctcaaccttggcaaccagctcgaacttgacagccagttcctcgaatccctcctcgcgggcctcgcgggccatacgggcatacatgtcggtccactcgtagttctcgccctcagccgcgtccgccaggttctcctcaacggtgccgatgccgccgtgcagctccttgaaccacatctttgcgtgctctttctcctgatccgcggtctccagatataaagaagccatctgctcgtaaccggccttcttggctgcggaggcgtaataggtgtacttattgcgggcctgggactcgccggagaatgcgtcctttaagttctgctcggtctttgttcctgcgtattttgatgccatgtttgtacctcacctttctcgtttgtataatttaatgctacctatcctctattgtatgccatattttggcaaaattcaataaaatttttagtaacagttcagatggcgagaaaattggcgcggtaagccgcgtcaagctcgcttgtaagcgggtttccacgccaattttcacatcggatgtcttttcggtcaagaagatgagccgtctgaacggttacattttttatcaaatatcaggtgcgccggcgtttccagcggggatttaccggataccgccggcgcgtttggcggaaggatcagccgaaatatctctttaacagaccctcaaacgccttgccgtgacgggcctcgtcctttgccatctcgtgaacggtgtcatggatcgcatccaggttcagggctttcgctctcttggccagatcgaacttgccggcggtagcgccgttctcagcggccacgcgcatctccaggttctttttagtggagcttgtcacaacctcgcccagcagctcggcgaacttggcggcgtgctcagcttcttcaaacgcggccttagcccagtacataccgatctcgggataaccttctctgtgagccactctggacatcgccaggtacatgccgacctcggagcactcgccctcgaaattcgctctcagatccatcatgatatcctcgggggaaccctgagccacacctacctcgtgctcgcaggcccacgccatgccttcgctctcctgtaatttgaacttggaagccggaacgccgcactgaggacacttctcaggagcctgctcgccttcatatacataaccacatacggtacatacccattttttcatgtttgttctctcctttttatgtttgttctttttatatcaataatagtaattgttactgatattaatataaacgatctcagacgatttgtcaacacttattttaaagtttcagatgattttttccaaccggacggaaaggggagaaatcaggcgcggggtgcggattgaggtaccattgaggccctgtcataaataccttttgacatttactcctcacttacgttataatgtacaagttaagacattgggagtggggatacgatgataagagagcgtaaaggcagtctttcggaggtggcggcggagtatgtcagggaacagattctgaagggagtgctgcaccagaaggaaaagattgtggaaaatgacatagcggtggagctgggtatgagcaggggacctgtgcgtgaggcgcttaagcagctgaagtatgagggattcctggactatgagaccaacaagggatactccgtatccatgctgtcgcccaaggatgcctatgagatattttatctgcgtggaaatctggagaatctggctcttaaccggtgcgggggccgcctgttgagcgacggtatattcctgatggaggacgctgtgctggcgatgaaggatgcggtggcggcagacgatctgcctcaggtcatcaagtatgacgagatttttcataagcagatcatgatttcagggcagatggaacgtctgaccaacctttgggaatccttaagcccactaaacggagctatgttctacaccattgagcagatcaacgcctatgtggcggagaagcagcttccctttgaccataacgacgcggcggcccgggacgggcggcggggcaacaattacctggagcataagtggctgttgaatattttaaaacagagcaacctggagcgttctgtggatgcgatcaacacccattatataggaaacggagaacggatttaccggatcggaatgaagatggaaaaccaggatctctttttgtaacatcatacataaagaaatggggaggcgcggctgcgtctccccatttttattggatgcaatgggccgcaggcggtccactgttttgcggccaaacggcggtaaccgtcataaagctgcggtaaggccgtcatgaagctgcggcatggctccgatctgccggcagatatactccatatcctccgcgtcaaacctctgatcacaggggattgagagcacgtggctgtagatgtagtccgcgtctgcaaagccctccgtatccaccatggggccttggggccagtaggtggtggattttatcccatgcccggccagatacttctgcaccatgtcgcggtcggccgcgtacacggtaaaatggctgggaacggttccttcgggcagccagggaaacaccaccgtaagctgcgggtgatccggcatatggtccagcagatagcggtagttggcccgcctccgctcctttaagcggttaaagtcgtagcggcggatgatatcgaccgacttatcatcgctgccgtagctgtcgaagatccggcgcagcatcatttcggcctcccagaaggcatcactcagctgctgcaaggtctcgttctgggggtgtccgtcgcagtaggacatcctctgcgaactgccttccatgagcctggcccgcagggtcaggtgggtccggtccggctccttcaccggcagggtgaaccttcccttgcgcttgatggcaaagcctccggcggacacgccgatccattttctcaggctgccgaccacatagtcgctgtatggatccaccccgtcgtcggagaagatggagtgggtggcgtcttctacaatggcaatgccccgctcggagcattttcggatgaaatcccggtcgtaattgcagaagccgtagtagccgcacaggttgagtacgctgatatcatccaggaccgtctcgtcaaagaccggactcatatccctggaaacgccgtaaaatttaagttggtagcctgccttcaggaagggagccagcacggtttcacaggtgtatacggggacataggcaacctttttcgtatcggtcaggcagatgtcctccagagcgtagtagtttgcacagcggccggacataaagtagccaaggctcccctcaggcgggcagagggattctaaaaagtggttttcaacttcgggcaacggttcgagagcaaaaaatccgccgatctgtttcataattgcagtacctcccggaatatatgcctcccgcaggcgcgtgtcgaacaggcgtgtgcgtggtacgaggacaaattgattttgtgtaaggacaagtatagcatggaattgggaaaaattacaatagaaaatgttgacaaaatagtaatagtgtaaaaaagatacaaagattgttgacaatgttgggaaattgttttattattagaacgaagcgagggagtttcaggtccttaagcttcttttttgttattatggttcccggccttttatcccagctgagaagcaaccataatcctttgctgcgttaaatcggcaaacaaacgaggaatggagagagaaatatgtacaagtatgtgttgaaaagactgcttatgctgattccggtcattatcggcgtgacgttcattgtattttttattttgaacctgtcgccgggagatccggcggcgattattctgggcgaccaggcgaccgcggaggcgctggcaatgaagcgggaggagctggggctgaatgatccgctgctggtccgctatggccgctatatgttcgccatgctccagggagatctgggcacctcctacaaaaataatctgagcgtgtgggcccaggtgatggagcgcttccccaacacggcggtgctggccactgccggtattctggtggccatcctcatcggaattcccacgggcatcctgtccgccaagagacagtattccatgattgataacactgctatgctgttctcactcatcggcgtggctatgcccaatttctggttcggcctgctgatggtgattatcttcgcccttcacctgggctggctgccttctcaggggatgggagagggatttatcccactgattaaaagcctgattctaccggcggtgacgctgggaaccggagcggcggccatgattacgcgcatgacccgttcctccatgctggaggtgatccggcaggattacatagacacggccagagccaagggcgtttccgatcagaagatcaccacccgccatatgctgaaaaacgccatgatccccatcatcaccgcggtgggacttcagtttggaaccctgcttgggggagccatgctgacggaaaccgtattctcctggccgggactggggcggctgatggtggattccatcaagtcaaaggatattcccatggtgctgggttcggttattttcctggcaatcatgtttaccgtggtcaacctggcggtggatatcatatacgccttcgtggacccgcggatcaaatcacaatataagagaaagtaggtgcagctcatgggaaagaaacatctgattgccgtggaagcggaaggcagccagcgctcgctgtggggcgaagcctggcgcagatttaaaaagaaccggatggccatgatcggtatgtatttcattctggccctggtgtttatcgccattgcgaccattattatagatgcagttacgggaaaatccatttatctgaatcacgtggtcaagcagaacctgagaggacgccttcagggacccagcctggctcatcccttcgggctggatgagtttggacgggatatgctgctgcgtatgctctgggctgtgcgctactccctgttcatgggcacggtggctattatcatttcctgtatcttcggcggtctgctgggagcctttgcgggatattacgggaagacggcggacaatatcattatgagaatcatggatatccttctggccattccctccatgctgctggccatcgccattgtggcggccctgggaaccagcatcacaaacgtgctgatcgctatcgccatctcctatgtgcccaccttcgccagaacggtccgggcatcggtgctgacggtgaaggaccaggagttcatcgaggcctcccgggccatcggctgcagcgactggcgcatcattctcaaatatgtaattcccaattccatggcgcctattatcgtccaggtaacactgggaatcgcaggagccatcctctccatcgcaggactttccttcctgggactcggcattcagccgcctacccctgagtggggcgcgatgctgtccaatgcccgcagctatatccgcgacgcatggcacgtgaccattatcccgggcatgggcattatgctgaccattctggctctgaacctggtgggtgacgggctgagggacgcccttgacccgcgtttgaagagctgatgaagaaaggattggtatgacatggcagataaaccattattggaagtaaaggacctggtcatccactatgagacggatgacggggtagtgaaggcgttaaacggcgtcaatatacagatcggagtgggggaaaccctgggcctggtaggcgagactggggcgggcaaaaccaccctggccaagggaatcatgggtctgatcccccaccctccggggaaaatattaagcggcgaggtgcagtttgagggacaggatcttttggcccttggcaaggaagggatgatgaaaatccggggcagggacatctccatgatcttccaggaccccatgacctctttaaacccggtactgaccgtgggcgagcagattctggaggtgattgagatccataatcccggcctgtccaagcaggaatccagaaaatgggcggagaacatgctggagcgggtgggaatcccggcggaacggttcggagagtatccacaccagttttctggcggtatgaagcagagagtggtcatcgccatcgccctggcctgcaatcccaagcttctgatcgcagacgagccgaccacggccctggatgtgaccatccaggcccaggtgctggagatgatctatcaactgaagtcagagaacaatacctcgatgatcctgatcacccatgatctgggcgtggttgcccagaactgcgattacgtggccatcatctacgcgggcgaggtggtggaatacggatcgctgcgggagatttataaggacacgaaacacccatacacggaggggctgttcggctcaatccccagcctcacaagcgacgtaacgcggctgcaggccattgacggcatgatgcctgatcccaccaggctgcctgagggctgcgtcttctgtgaaagatgtaaatacgcgactcctgaatgctccaagtcccatcccgggatcgtgtccctgggcggcacccatcaggtgcgctgcctccgatacggccgtcaggcttcggatatgaactgaggaaggagatttacagatgcaggaagagaagaaagagcttttacgcgtagagcatttgaagaaatattttacaacgcccaagggcaccctgcatgcggtggacgacgtgaatttctccatccgcgcgggcgaaaccctgggcgtggtgggagagtccggctgcggcaagtccaccatgggcagagccatactgcggcttcacgagcctacggcgggcaaggtgtattttgagggaaaggatattctgggctataacaagaagcagctgaaggaactgaggaaggacatgcagatcattttccaggaccccttcgcctccttaaaccccagaatgacggtcagcgaggccatcatagagccgctgctggtacaggggatatataagtccagcgaacgggcggccatcatcggccaagtggacaagatcatgaacctggtgggactggcaaagcgtctggtcaatacctacccccatgagctggacggcggacggcgtcagagaatcggcatcgccagagctttggcggtgaaccccaagtttatcgtgtgcgacgagccggtgtccgccctggacgtatcgattcaggcccagattctgaatctgatgcaggatctccaggaggagctgaacctgacgtacatgttcatcacccacgacctgtccgtggtcaggcatttctccaacaatattgtggtgatgtacctgggccagatggtggagtgtgcgcctgcgaaagccctgtttaagaaccccttgcatccttatacgaaggcgctgctgtccgcgatcccggttccggacccggatttcaagatggagcggataccgctcaagggagaactgacgtcgcccatcaacccggacccgggctgcagattcgccaagcgctgcccctatgccacggaggcctgcaccagcagggagatgacgttgatggagatggagccggagcactttgtcagctgccggatgatccaggaacagagataaattccggctgaatccggcatttatagataggaaagctgccgccggtccctgttgggccgccgtgcagcgccagcaaaaaaagagaggagcaaaagtatgagaaaaacatggaaaaaggcgattgcattatccctgattgccgcaatggcagttagcgcggccggctgttccaaatcgggacagccccccacagacggcggcgccgccaccgaggctgcatcaaaggatgccgcaggagatacaacaggaggcggctccggcgagtacaaggataccttagtatgggcacagggcgcggacgtgacctcccttgacccccatcagggcaaggagaccccggcagttgaggtgacggatcagattttcgacaccctgaccgtggttgacgcggccaccggagagcttcagccccagatcgcggagagctggacccagaattccgaaacctcctacaccttcaatatccgcaagggcgtgaagttccatgacggttcagaggtgaaggctgaggacgtgaaattctccctggagagagccatcaattccgcggctgtttcctatattgtggactttatcgacaaggttgaggtagtggacgattacacggtcaatgtggagctgaaggcgccctacgccccggccctcagaaacctttccgttccctttgcggccatcgtgcccaaggctgttgtggaggccaacgaggcggagtttgtgcttcaccccatcggttccggcccctacaagttcgtagagtggaagcagggcgattccgttaccttggagcgctttgacgattactacgcaggagcggctgagacccagaaactggtgatgaaggtgatccccgaggcgtcacagagaaccatcgccctggagaccggcgaggtggatctggcctacgacctgcttcccaacgacctggagaaggtgagaagcaattccgatctgcagctgttcgaggctccgtccctgacctgctactatatctccatgaatatgaacaaagcgccctttgacaaccagcaggtaagagatgcgatcaactacgccatcgaccgccagctgatcatcgacaccattgccagcggctccggcgagccggccgacgcaattatcgctccggccgtattcggctattccagccccggcgcatatgagtatgatcccgagaaagccaaggctctgttggctgaggcaggttatcccaacggttttgagaccagcatctgggtgaacgacaaccagacacgcgttgaggtgtgccaggctgtacaggctatgcttcaggaggttggaatcacctgcggcatcgaggtgatggaattcggaagctttatttccagaaccaccgccggcgagcatgacatgggctacttcggatgggtgacctccacaaccgacgcggactacacctactattccctggagcactcttctcagcagggcgcggcaggaaaccgtacctttatcaatgatcctgaggttgacaagctggttgagaccggcagaaccagcgcggacgaatccgtcagactgaaagcatatgaagagctggctgttaagctgaaagagatcaacaacaacgcgcccatctattacagcaccattaccgcaggcgcaaacgccaaggtagagggctttgtgatggatcccatcggctatcacaagctggatcgcgtaaaggtaggcaaataagagaggtcaaaggaggcaagcaacatgagattatctaagattacatggcctgcggcagagtcttattttaaagaaaacgatatggtgatccttcccatcggaagcacggagtgtcacggacgccatatgccgctgggaaccgacaccctgatcccggacaagattctggacctgattgaggagaagaacgacaacatcctcattgcgcccatgatcccctacggagcctgccagtccctggcagactatccgggaaccatcaacattgatcccgacgtgctgtaccactacgtgtaccagattgtggacgggctgtacaagcacggcgcacgcaagattctggtgctcaacggccacggaggcaatatcaagaccatcgagcgcatcggcctggaatttgacaaaaagggggccatggttgtgatgctcaactggtggctgatggcctgggatatgaagcctgagtggaagggcggacatggcggcggcgaggagactgcgggagtcatggcggtcgatccgtccctgatcgatatgagccagatcgaccttcctctggagatggccaacatcaccgacaacctggttgccaccggtttccgcaccgtccgcttcaagggcgtggagatcgacattctgaggaacacccccaaggtgacggacaacggctggatcggacctgatcatcccaacacagcgaccctggaatggggacaggaaatggtgcagaccactgccgactacattgtggatctggttgaggagttaaaaaaggttacgctgtaatatacggaaaagcctggaggtaatgatggcaaacattaaagaaatagaggcgttgaccaacgccttcggtcccagcggttttgaggaagaggtcatctgtgaggtaaagaactggtgccaggggctggacgtgaaaaacgacgccatgtacaatgtgtatgcgaccatgaagaacaggaaggagggacgtccggttattatgctggacgcccatctggacgaatgcggattcatggtacagtctatcctggagaacgggcttttgagcatcctgatgctggggggcttccacctcaccagtctgcccgcccattccgttattgtgcggacccggtccggggaaaagcacagggggatcaccacctccaagccggtgcattttcttactccggcccagaggaacgacaattccctggacatcgaggacattctggtggacgtgggcgccagcagccgggaggaggccatggaggtctacggaatccggccgggtgatcccattatgccggatgtgagctttgagtatcacgaggcaaacggcattatgtacggcaaggcctttgacaaccgtctgggctgcgtcagcatcatcgaaaccatgcaggccttaaaggacgaggcggaccggctggcagtggacgtggtaggcgcgtttgcggcccaggaagaggtgggcaccagaggcgccaccgtgacggcccagcaggtgcagccggacctggcgattgtgttcgaaggctctcctgcggacgactttttcttccggccgggactggcccagtgcagcatgaagggcggagtgcagatacggcacatggacaacagctatatctccaatgtggagtttatccgtctggcccaggaggtaggcgaccggtgcgggatcaagtaccaggatgcggtgcgccggggcggaagcaccaacgcaggtaagatcagcctgaccgggaaagcggtccccgtgctggtgctgggcatcccctccagatatgtgcacagccactacaatttctgtgcggctgaggatgtggatgccacggtcaggatggccgttgaggtaatacgggcattggatcaggagcgcattgcgcgtattttaagaaaagatatgatctgaatcaacatccctgttgggatcgggctttacagagctgcccgttccaacagggatattttcctataaaaaggggttaaaatacaaaaaatccgcttacttttgtccgtatcccgggtgccaactctgataatctttacatataggcgagaggcggtcgtcagcggatttagtttgatggctgcggttattgcggctccaaacatataatttctatttaataaggagggtaatcacatgagggttggatttattggattggggattatgggcaaacccatggcaaaaaatttgttgaaagccggttatgagctggttgtcacggacctgaaccaggcggcggtggaggaactggcagcctgcggggcacagactgcggcaaacggagcggaggtggccggaaactgtgaggtggtaatcaccatggttcccaactccccccacgtgcgggcggcagttttaggagaaaatggagtggtatatggcgcgaaaccgggaacagtgctgatcgacatgagttccattgatcccaccgagagtaaagccatcggggcagagctggcggccaagggcatcgaaatgctggacgcgcctgtatcgggcggagagcccaaggccatcgacggcaccatatccgttatggtgggcggaaagaaggagctgttcgaccgtcattatgatctcatgatggccatggccggttccgtggtatatgtgggagagcttgggtccggaaatgtggccaagctggcgaaccagatcgtggttgccgtgaatatcgcagctgtgtcggaggcccttacctttgcaaagaaggcggggaccgacccggagttagtctatcaggcgatccgcggcgggctggctggttccacggttatggacgccaaagcgccgatgatgctggcgggaaatttcaagccgggattccggattgaactgcacatcaaggatctgaccaatgcgctcaatgcggcgcatgccatcagcgcgccggttccgttaagcggtcagcttatggaaatcatgcagtgcctgaaggcggacgggtatgagaaagaagatcacagcagcattgtcaaattctatgagaagctgtccaatgtcacagtgaagtcataatccctatttatttgcggttccggttattccggaaccgtttttgattgcctgcaatccccacgcagctctcaacgggaacacggttgagaagaaaaaggggttaaaatacaaaaaatccgctcgtatttgtcctaagcgtggctggtaactctgctaatctttacttatggattaggggaatccgttggtcgatttgtctaaaaattaaaaatcctttgtgtgcctcgctatttcgaggacttatcccttatctcaagtgtatttggtttggttttgacagtaattgtggttacataattcgaaaattcatattaatatattaattatagagaattatgcacgaaaagatagaaagatgaccattactgttgaaattttccgaattttataatatactaagaaaaacacaaatattcgggagaattcacgtattctgacagcagtttcgacaattatatagagccggaaatgagaatcaccatagaaaggacaaagactatgttgtacataagaaacggcagaatcaaaaccatggcggggattgagtatcccaacgggcagatcctgatcgcggacggcaggatcagggcggtcggtgagaacgtggaaaaaccggagggcgcccgggagattgacgcgggcgggcatctggtaactccggggatgattgacgcccactgccacgtgggactgtttggcagcgctctgcgctgggaaggcgacgacggcaatgaggagatggaccctatcacgcctcatctgcgcggtatcgattccgtcaatccccaggacgaatgctttgaaaacgcgcggaaaggcggagttaccaccatagccaccggtcccggaagcggcaatgtcatcggcggcaccttcgcggcgctcaaaacctacggaaaacgggtggacgacatggtgatggtggaaccgctcgctatgaagatcgcatttggagaaaacccaaagagcagctacggattgaacggcaaatctccctacagccggatggcggtggccgccctgctgagagaggcgctgtttaaggccaggcgctatgccgaggacctggaggagtatgagaattcaggaggcggtgataaaaagcgcccgccctttgatatgaaaatggaagcgctgctgcctgtgatgcgcaagcagatcccgttgaaggcccacgtccaccgcgcggacgacatttgcacggcgatccgggtggcgaaggaattcggcctgaagctaaccatcgaccactgtacggacggccatttgatcacagaggtgttggccgcggagggctatcccgtgctggtgggcccgacgttcggagataaaacaaaacctgaggtcagaaacaagaccttcgatacagtgaagattctgtcggatgcgggccttcaggtggcgatcattacggatgccccggtcatccccattgagagactgcccctgtgcgcgggttatgccataagcgccgggttagaggagcagaaagcctgggagtgcatcaccatcaaccccgcccggatcatgggcgtggacggccgggtgggcagtatagagcccggcaaggatgcggatatcgtcatccacagcggcaatccgctgacggacattgtttcccatccgctctacaccatcattgacggtaaaattatttatcaagcgtaaatatatgaagccaaaacaaggaggatattaaaatgtatcaggggaaaacacacattcacatcgaaaacagcgacggctcaccgcaggtatttaacgccacctggcagcaggttcaggatcttctggaccgcaatcccgatctgaaggacgagctccacttcaccatcggctgtagcgacgcggacccggtagcccagtggtcccaggaagacctggatgagtattacggctatatgaaaaccgccgatatcctggtgggatacacccttcctcagcagaatatcaaggaatacgccccgaacctgaaggtgatccacttcatcagctccggcgttgagcatgtgaccccctttgactgggttcccgagggaataaccgtggtcaacaaccggggcgtgcatcttcccaaatccggcgaatccttcgcgatgttcctctacatgatcaacgcaggaatcccgcgcctggcctattcccagaaaaagggaaaatgggaccggcacttcacctctgtgatcaagggcaagacccttgtggtggtaggcgtaggccaccagggcggcgagatggcccgccaggcgaaacggcttggcatgtatgtcatcggcgtcaacagccccgtggtggaaaatgaatactgcgacgagattctgccggttgagagaatgaaagaggcctttgagagagccgacatcgtttccctccatgttccgctgaccgacgccacccgcaaaatgatcaacgaggaggccctcagctggctgcccagccatgcgggactcatcaatatctcccgcggccctgtggtggatgagaaagcccttcacgacaagctggttgccggcgagctggcctgcgccatctccgacgtgttctggcaggagccccttccggcggatcatttcttctgggatacgccgaacctgacgattctgccccatatttcgtccgacgaccttgtaaactacatcccgcgcacgctggatctgaccatccgcaatctccgcaacgcgagagagggcaagccccttgagaacgagcttgacctggccagaggttattaatcgggaggattaagacattgaaaaagatgaacgtaatgatcctgaccgcggatgacagtaaaaaggtgtttcggatggaccaggaacgcctggaggcggccctttccagacatccccaggtcagagagctggcagattttgagatttgccggacgtccaccagctatgagaatgatcccggctggaacgaacaggatcacgagatgttttaccgcgcggcagcggacaaggacgccatcatcgggtatatgttcccactggagactttccgggagaaagcgcccaatgtgaagtatatccacatcataggagccggagtggagcacctgttcccgttaacctggctgcctgagcacacgaagctgacaaacagccgcggcgctcacgcccccaagacctgcgaatacgccatgatggccatgttgatgctgggcaacaacatgccgaggctctacaccgcccagcgggaaagccgctgggacggacatttcctcaccgtggtggagggaaaaaccgcgctgatcctgggctgcggcaagcagggctcggcggttgcgctggctgcaaagcgcctggggatcagggccgtaggcgtggaccccaaggtttcctcaaaagaaggctttgagagaatcgtccacccggatgcgctccttcaggtactgcctgaggccgattatgtgttcctgaccatgccgtataccagtgaaacctatcacttcttcggcgccgcacagtttgaggccatgaagccgggcgcagggtttgtcaatatctgccggggcaaggtgctggacacggacgcaatgatcgccgctctcgaatcgggtgcgatttccggcgcggtgctggacgtatacgagcaggagccccttccggcggactctcccctgtggacggcgaaaaacgtgatcatgaccccccacatgggctgtgacgacgaggacaattatattcacagatgttttgacatcttttttgaaaacctggtcaggatggcaaacggcgaggaattggacaacatggttgaccggaacctgggctattgacgggcttcacaacctcctggtacaggaagagaatataaggagaagagtatgaatggtacagaaaacaccgggttacaacatcttgcggtacagattgtaacaacatacgagcgtatgaaacgaaatgcggcctaccgtgtgctttcgctgatctttggctgcattactctggtgattgtcaagctggtacagatggcgtccaaggaaaagaatactgccaggatccgtcgggatcagctgtacaaggagcttgtgaatcagggggagctggccgcgcttcaggaggaggcggcgcagcagatcagacggaagaaccagtttttcaataaaaaaatgccggagagcgaagtacagcgccaggccgggaagatcggcctccaggaatttgaggagaaggtgaaccgcctccttgagaacgagggcatcgacaccagcacgaacagtgaatttcatgatacctttgtagcactgctcagtaaaatgccgttttttgttttctccgtgatcgtctcattcccaatgtacattctggttgcgatctatatgcagccatacataaagtttacggtagaccgtatggcgatgctggtcttcgttctcttcggcgttatctttttggttttctccatcctctatatttcgccgtccgacccggcggtgaatattctgggggacaaggccacgccggagaaggtcgagcagttccgtgaaatctatggtttgaacaaaccgtatctgggacagtttttggatacggtaaagcggatcgccacctttgaccttggcagatcctttgtgggaaatgagaacatcaacgaggccattgcccgcaagttccccgttaccatgcagcttgcgctgtgttccatcagctgggccattctggcgggcatcgcggtgggcgtggtttccgccatccggcagtacagcgcctttgacaatatctccatgctggtggtgctgctggcgctgtccatcccgcatttctggctgggccttgtgctggtgctgaatttctccatcaagctgggatggcttcccgcgatctacaaggcgggcgaatggaagagtatgctcatgccggcctttgttctgggaaccggctacgcggccggtatcgcccgaatgaccaggtccagtatgctggaggttaagtcctcggattacgtgatgaccgcaagggccaagggactcagcgagcgggccgttaccttccgccacattctgagtaacgccctgattccgattatcaccatggtaggtatgcagttcggcggtatcgtagccggagcgcccaccacggagaaggtgttcggcatcagcggtatcggtatctatattgtggaaaaggaatttgtgccggatacgccggcggttgtggccagcgttgtgtactgttccgttgcaatcagccttgccaacctgctggtcgatattttgtatacgttcattgaccccagaatcaagacgcgtctgaaagattattaggaaaggggggaatgtgatgaaattaactgaatatcagcaaaaaatgaacagaatcaagttgggcggcttcgtggaacacaagaatatggcgttttccatgggcgcgaccatgattctgtgcctgatttttatgcttgccagctatgactttatcgaaggcaaggttaatacgattatgcttacggtggcatgcctgtatctgattatgtccctttacatgtacgcggtgctccagaagatcaaaaaagatatcgtgacaaagggaaccatcagcaacggcacaaggcggctgggctggcccatgacattgtttgtgctgaccggcaattttttcggcaccatcggcggcatgtacctgctttccaagaaaaagtgcatcgaatatcagttatccgtgtacatggtcgccaacctgctcatggtgatgctggtttccaccatcaatattttcaagcctgcaattccctattattttgacctgggcatggggctgctggtggttgtgctggttttctacatctttgtggcagtcatgctgtcgaagcatgcggatgagcataacatcgatcccaggctgaaaaagctgctgatccccctggccctcagcgtggtgacgggcaacttatttgctctggttctggtgattaccatgtataagcgcctctaccagaagaacaaagagatttccatcgagtggattgacattatgcggcggctgttccgcaactatatgtcggtcatcggtatgtttatcgtcattttcctggtgtccatctccgtatgcagttacctgacctttgactacgccgtgtcggtggagaacaactacagcgcgctgttccagcctccgtccctggcctatccctttggaacggacaacttcgggcgctgcatcttttccagaattgtgttcggcgcgcgtatttccctgagcgtcggtatggccgccatcgtgattccgctgcttgtgggcggaaccctgggatccatcgccgggtattacggcaaagctgtggataacatcatcatgcgcgccctggataccctttatgcgattccttccatccttctggccatcgccattatcgcatcctttggagccagcaccatatccctgatcatggccatcagtattgcgggtatcccggtttacgcccgtcttgtgcgcgccacggttttgggtattgccaactccgagtacgtggaggcggcaaaggcctgcggcgcgaccaaccgcatcatcattttcaaacatattgtgccaaattccctggctcccctgatcgtgcggtccacccttgaaatcggtaccgccgtgctgtccaccagtacgctcagctatctgggaatcggtattccggcgcatattccggaatggggcaacgtcctcagagcgggcagcacctatttggaggagcatccgtatatggctattttcccgggccttgccatcattctgattgtgttggcgttcaactttttcggcgacggcctgcgggatgctctggatcctaagatgaagtaaggggaggtggaattgtgacagaaaatttacttgaggttaagaacctgtctgtgaattacgtgaccgaggaccgcacggtgaaagccgtaaacgacgtctccttcagcctggccaagggcgagagcatggggcttgtgggggaaaccggagccggaaaaaccacaatcgcgctttccgttatgcagctggtaccgtatccgcccggcattatcaccgggggagaaatctatttcaaaggcacaaatttaattgagaattccgagaaggaaaatgagaagatccgcggcaacggcatttccatgattttccaggacccgatgaccgcgctgaacccgaccatgaccatcgccaaacagatggtggaggttgtgatgaagcacaccaaatccaccagaaaagaggcggaggagcggtgcaagaaactgatggagacggttggaatccggcgggaccgttttaacgactacccccatcagctctcgggaggcatgaagcagcgcatcattattgccatggccctgctgtgcagcccggaactgctgattgcggacgaaccgaccaccgccctggacgtgaccatccaggcccaggtgctggagctgatgcgcgagttgatcggcaagtccaatatgtccctgattttgatcacccatgatctgggcgtggtggcggaaacctgcgacaaggtctgcatcatgtacgccggagagatcgtggagaccggtctggtgaagacggtgtaccgcaacccgcgccatccctatacacggggcctctttgaatccatacccaggctggaggacgacgacgtccgcttaacgcccattgaaggctcgattcccaacccggccgcgctgccggagggctgtaagttccatccgcggtgcaaatattgttccgaaatctgcaaaaaggaaaagccgccggtgcgggtggatcaggagacaggacagtcgtttatgtgccattttgatctgtttaacggaggtggtgagtagtggggaccttattggaggtgagaaacctcaaaaaatatttccaggtaccaaaagggtatctgcacgccgtggatgatgtgagctttaagataaacgagggcgagaccttaggaatcgtgggcgagagcggatgtggaaagagcaccctgggccgcgcgattctccgcctgcatgagcctacctccggcacggtattgtatgacggcatgaacgtcaccgggatggataagcaggagatgcgggccctgcgcaaatacatgcagattatcttccaggacccgtacgcctcgctgaatccgcgttttacggtggctcagatcatcgaagagccgctgcggctgcacaagatctattcttcggaggctgaggtgcacgcgcgggtggaggagctgatggacatggtaggtctctccgcccgtatgcagaacgcctacccccacgagtttgacggaggccgacgccagcgtattgtaatcgcccgggccctggccgtgggaccaaagttcatcgtgtgtgacgagccggtatcggcgctggacgtttcgatccaggcccagattctgaacctgatgatcgacctgcagaaggaattgaacctgacctacattttcatttcccataacttaagcgttgtgaagcacatttccaccgatgtgggcgtgatgtaccttgggcagctgattgagaaggcgcccaagagaatgatctataaaaacccgctgcacccgtacaccattgcgctgttagccgccatcccgtctctggacccggaggcgaagcgggagcggcagattttaaagggtgagctgaccagtccagtcaatccaaagaggggttgcagattcagcaccagatgtccgtttgcgcaggaccgctgctttacggacaaccccgtcatgagagaagtggagccggggcattttgtcgcctgtcaccgggtttcagggaaggaggggattcagtaaaccggtattaaaacgagatttaaagaatgctgcacgaatatgtggttaagaaaagggagaggagaaacagaatgaaatctacgagaaaagcattagcactgctcttatgtgccgctatggttatgtccagcaccgcatgcggacgcgccagggccgagaagccgggaacagccaccaagacggaggaggcgcccatccccatcaccattttgacccgtccgaactttgagctggaggccaacaccctgcgcgatcagctgaccaaggccggttttgaggttaccgttaatgttcagccggaccgtgcgtcctctttggcggttcaggagagcggtaaatacgacattaacattttaaactggctgaccgatgccggcgcgccggactacgcggtgagacagctgtatcacaatgacggttcctacaataactggcccatcaaggacgacgagctttccgccctgatcgacgaggccgcccagctgaccttcgaggattccatcccggtctataccaagatcgaaaaccgtctggtggacgagatgtgctggaccgttccgctgtacaaccgtaccagatttgtggcggtgaataaggacatcgtcgatcccgacaccattttctgcggcggcagcaccccccggttcttcggtatgagcgagtatgttgacaagagcctcagcgagacccgtccctatgtcgcggttcagtttgaccccaatcctccgaactttgatccgattcggacagaagagggaagcaccttctggatgaaggccaattcctacatttccctgacggcctgcaacgcaaaggacgaggttgtgcctgagtactccttaagccgtgcgtttgccatcggcgagggcaattccaccttctatttcatgctccgcgacgatgtgaactttgcaaaggtagaggacaacaaggcggttgacacaggcgttctggtcagtgctgaggacgttgtatacaccctggagcgcgcgaaagatcctgacgcggtccccttaaacagcggttataccaacctggagtccgtggacaccatcggaatcgtgaccgatctggaggagcttaagaatatcaaggtttccggttcttctcagagcgtattcgattattttaacgagaaagcgcctgcccccatcaccaagctgaccgaggagacctctgaggttgacaacgcggccggcgtgtgccaggttgtgaaaatcaccaccttcaagcccactccccagctggtgaacttcctgaccatcagcaccctggggattgtgtgcaaggacgttgtatccagcctcaacgagggcattgacgccaataactatgatccgtccaaggatgtgctgtacggcgatgtgaataccttaaaggaaggctccgctcagtttaacaacaacaactggttcagcggtccttacgcaatgctgtatatcaacgactatgagatggtgtttgatcgcaatccgggattcatgcctgataccgaatgggctcccaatattaagaatctgaacatcaagatgatgtccgatatgaacaccgcttactcggctctgcgcagcggcgagatcgacgactgtatgccggaaggaaactggggttccctgaaggaagctcccaacgtagccatcgtggagcgggaatccacctctgtgtccacactgttcttcaacctgatggaaggcagcaagatgaacgacatcaacctgcgccaggcaatacgctacgcggtcaaccaggatgatatcattgcaattaaggaaggaactgttacacgggcgcactccacgctgaccatgatccccaccggaaacgagtggaacgccgacctggcgaagtccgcggagtatttacagaaataccgcgattccctgaagtaatgcaaagaggtgattggatgaataaagcaattaaatgcggcaagctgttcaactccatagacggcagcgtaagcgagaaccaggttgttctggtcgagggcgagcgtataaaggaagtcgtggatgagcagggcttctgccaggaggggtatgaggtcattgacctgagcgataaattcgtgatgccgggcctcatcgactgtcatgtacatatcagcgaatacggagcgccggatacatttagaatcagcgccacccagctggtgggcgacggcacgctgatcgctctgaaaaacgcgcaggcccagctgatggcgggatttaccaccctgcgcaaccagggttccccgggatttctggacgtgtccctgaaaaatgcctttaacagcggcatgttcgacggcccgagaatcgtggcctccggctcctgtatcgggtccaccggcggacacgcggactcccactacagcccctacttaaagacggtctacgatatcatcgacggtctggtggtagacggcccggatcaggccatgagagcggcccgttacgtgatcaaatacggcgcggacgtggtgaagttcatggctaccggcggtgtgacgaccatgggaaccacggtgggcgcgcagcagcttacctttgaggagatgcgcgcgatgtgccaggtcgccgagatgtacggcgtgacctcgtccacccatgcccacggcaccggagggatcaagaccgccgtcaaggcgggcgtcacctccatcgagcacggcaccatgatggacgacgagtgcgtggagctgatggtggagaaaggcacgtacctgacgcctaccatcatcgcgttcaaacgtatgatggagcgcggtgaggaggagggcattccgcctcacgcaatggagaaagccaagaaggccggccagtatcaccaggagagcttccgaaagtgtctggaggcgggagtacccatcgtattcggaacggacagcggatcgccctgcaatccccacggacagcagcacgacgagtttaaattcctctgtgagatgggcatgacgccggttcaggcgctgaccgccgcgacccgcacgggcgctcatctggttcggatgtgggatgatatcggttctgtgacagccggaaagtatgccgacattatcgcgctggacggaaacccgctggagcacatcacggatatggcgaagaactgcttcgtgatgaagggcggaaccgtgtataagaatatcggatgattgagagcagacagtagtttgcagatttttcaaatatcaagcgaatagcgatgcgaaaagacacacaatcctttccctttaaaaagggatgattgtgtgtcgcgcatattatgcaggctgatagccaaaggagacaaatgcccatgaagccgttaaaactgaatgaatttttcaattaccgttttctgtcaaatcttacctggtccccggacggaaaggcggccgcagtcacagtgacctccgccaacccggaggacaatggttacgatcagaatctgtggctgtacaggggagacggatttcgacagtttacggcgctcaacaaggagagctccttcatctgggatgatgagaataccatcctgtttgcaggcgccaggctggcttccgatcagaggcgcatggaaacggaggaaataaccgtattcaaccgcatcagcatccacggcggcgaagcggtcaaggcttttacgctgcccgtaaaggcggccggtatcaaaaagctgtccggcggcctttacctggtcacagccagctgcgacgccggagtgccggattattacaagatgagcagcgaggaacgggccgcggcccacaaggccaaaaaggacaatgcggactatgagatttttgacgagatccccttctggtacaatggcagcggcataatcaacaagctgagaaaccgcctgttcctgttcgacgagaggacgggggaactgagaccgatctccgaaccgctgtttaacgtcacctgctatgccgtgacaggcgacctgatcgtatacggcggggagtcctatcagaccaggcgcacggaccgggaatctttctacaggtaccggatcggggacaaggccagccaatgcattaacgacagccggggatacagcgagtgcagcctgttcgcggtggacaataccattgtactgatcggcgcttcgcgcgcacgctacggcgaatgtgagaacccatatttctataccctgtgcccggaaaccggggaagtcaaggtgctggccgaaaccgacctgtacgtcggcaacagcaccaacagcgactgccgctacggcagaaccagggcagcgaaggctgtaggagataagctctattttatctctacccagagaacctcctcttatctctacagcatcgatctgaccggcaaggtggagctggtgctggaaaaagaggggtccatcgacgatttcgaccttgtggacggcagcgttttgctgactggcatgtatgatatgaaacttcaggagatctatacatacagcctggatgacagaaccatgaaccaggtgagccggtttaatcaggaggtactggaaggcaaatatgtagcggagccggagcctgtcaccttcacgcaaaacggtgtggagctggacggctggatcttaaagcccatggattacgacccggacaaatcctatcccggcattctggacatccacggcggccccaagaccctctattccccggtttttgtccatgagatgcagtattgggcagggaagggctattttgtatttttctgtaatcctgagggcagtgacggacggggcaacgaatttgctgatatccggggaaaattcggtaccaaggattacgacggcatcatgaaatttgtggatgaggttttagccaggtatccgcagattgatccgtcccgcctgggcgttaccggcgggtcctacggcggatttatgaccaactggatcatcggccacaccggccgtttcgcagccgcagcttcccagagatccatttccaactggatctccttctacggcacatcggatattggcacttcctttggacccgatcaggtgaaggccaacatctacgacgattatgagaagctgtggtggcattcaccgctgaaatatgccaacaatgtgaccaccccgaccctctttatccactcagacgaggattaccgctgctggattccggaaggtatgcagatgtacaccgccattgtggacaggggcgtggacgccagaatgtgctgtttcaagggtgaaaaccacgagctgagccgctcgggtaagccgcttcacagggaaaaacgccttcaggagattacggactggatggataaatacacttgtaaataaaaacgcccgtctatccggcgggaaaaacgggaatggaacctgccgcggacctggtgaaggactgcctcgcaatgaggggcagagccgtgcagcgaacggtctgagaacaaaagacaggcgaacaaaggagctggcgcattgcgtcagctcctttttgtaagggtatataggaaatgaaaagggggagtcaattagccgaagtatctctttaacaggccctcaaacgccttgccgtgacgggcctcgtcctttgccatctcatgaacggtgtcatggatcgcatccaggttcagggctttcgctctcttggccagatcaaacttgccggcggtagcgccgttctcagcggccacgcgcatctccaggttcttcttggtggagcttgtcacaacctcgcccagcagctcggcgaacttggcggcgtgctcagcttcttcaaacgcggccttggcccagtacataccgatctcgggatagccctctctgtgagccactctggacatcgccaggtacatgccgacctcggagcactcgccctcgaagttcgctctcagatccatcatgatatcctcgggggaaccctgagccacgcctacctcgtgctcgcaggcccacgccatgccttcgctctcctgtaatttaaacttggaagccggaacgccgcactgaggacatttctcaggagcctgctcgccttcatatacataaccacatacggtacatacccatttcttcatattcgttctctcctttttatatgtttgtgtttctttaattgataatagtaattgttactgatattaatataaaccatagaagctgatttgtcaacacctatttgcaatatttttaattttttcttgcggactgcggctgaaccgcattccttttactatattccgcgagaaggaaaagattccttgcaggggcagaaccgggaaccggcagcaggggcggaaaaggcgccggttgggggaaccggcgcctttcctaaggaggatattaaaatttcagggggtgaaatcaattaaccaaagtatctctttaacagaccctcgaaggccttgccgtgacgggcctcgtcctttgccatctcatgaacggtgtcatggatcgcatccaggttcagggctttcgctctcttggccaggtcgaacttacctgcggtagcgccgttctcagcggccacgcgcatctccaggttcttcttggtggagcttgtcacaacctcgcccagcagctcggcgaatttggcggcgtgctcagcctcttcaaacgcggccttggcccagtacataccgatctcgggatagccctctctgtgagccactctggacatggccaggtacatgccgacctcggagcactcgccctcgaagttcgctctcagatccatcatgatatcctcaggggaaccctgagccacgcctacctcgtgctcgcaggcccacgccatgccttcgctctcctgtaatttaaacttggaagccggaacgccgcactgaggacacttctcaggagcctgctcgccttcatatacataaccacatacggtacatacccatttcttcatatttgttctctcctttttatatgtttgtgtttccttaattaataatagtaattgttactgatattaatataatataagtccggcagtttgtcaacaccttttcaaatattttttgattttttttatccggtttcgcaagcctattttataaagtccgcaggatataaaaaacgaaggtccgcagaaacgaaccttcgccttttgtaatgtcaatcagtctcaaatggctggaattaaccaaagtatctctttaacagaccttcgaacgctttgccgtgacgggcctcgtcctttgccatctcatgaacggtgtcatggatcgcatccaggttcagggccttcgctctcttagccaggtcgaacttaccggcggtagcgccgttctcagcggccacgcgcatctccaggttcttcttggtggagcttgtcacaacctcgcccagcagctcggcgaacttggcggcgtgctcagcctcttcaaacgcagccttctcccagtacaggccgatctcgggatatccctctctgtgagcgactctggacatcgccaggtacatgccaacctcggagcactcgccctcaaagttcgctctcagatccatcatgatatcctcgggggaaccctgggcaacacctacctcgtgctcgcaggcccacgccatgccttcgctctcctgtaatttaaacttggaagccggaacgccgcactgaggacatttctcaggagcctgctcaccctcgtatacatagccacatactgtacaaacccattttttcatcgtttttctctccttttttatttatatgatatttgtcaaattaatattagtaatcgttactgacattactataaaccaaccggccggttttgtcaacacctattttaaaaatatttattaaatctcagggaaatgtgcgttttgtaaccggaagtagcgtcgctgtgggcagacaatgagccgccggcgtgggccggcggctcggtgccgcgaatgttcgcagaacggtcaggcggacttatggatcttgtgatccgcgtgctttgccaggcagtcattgcattctcccagaaacagtacggaatgaccgtctacaacgccgggcgcaaattcctgagcggcggtgtttagggcctccattgtctccatgggcacgtcgtagacctgcttgcattccctgcacataaagtggtaatggggtctgggatttccatcgaagtggtccgcgccatcgccgcaggtaagccgctgtatttcaccggtttcaaccagcaggtttaagttgcggtaaaccgtgccaagactgatattgggatattcctcgcgaatgctggcgtatagggcgtctgccgttggatggtcgtgacggttcatcaaacaggctttgatggattccctctgacgactatacttgagcgttttcatagcatctccttccttatatctgtatctgctacgataatagtaatagttactattaataatatagtagattttccatggattgtcaagtgtggattaaaagaacgtaaaaaatccctgaactggaaaactctcccagttcaggggcagggcggttaatcgggattgtaggggatccgctctttggcgatgcggatgaattccttggtggcccgggacatgtagtggcccttgtggtaaccgattcccagaacgccgtgggcgcgccggaagttcagcgggtagggattcaagcgggcccgctccataaacttggtgcggtggtcctgggtggactggtcgttggacatgaacatgcgggggaagaaggtgatccccatgcccttggcgctcagggccagtaccgtctcgatattttccgtctccagcacaatccggggcgtgatctgggcttcctcgaacatttcgtccgcgatggtgcgcacccggttgccctttttcagcagaatgaaggggcaggactccagcagccgcaggtccgtggactgggagagttgggctttaatctcttccagcctgccggggtaggccttctccagcaccatgtccggcgcgattaagaggatttcctccgcgcagaccggcaccgtctccacattttccacggcaaagggcagcaggtcgatcatgagatcgatgttgccgtggagcagctccgaggccagggtgctggaattgccctcgatcagcttgagctcgatgccgggaaactgggtctggtaggagggcaggatctccggcaggatcacgcggccccgggtgtgggacacgccgatggacagctgcccggtggagaaatccttgatgtcggcgatctcgcggtaggtctcgtcccgcagatccaaaagctctctggctctggcctttaacgcctgcccggcgtaggtcagggtgagcggcagggtccggttgaacaggatcacgtcgaactccttctccaggttggagatgtggttgctgagggactgctgggagatgtagagctttctcgcggctcttgtgaaattcagctcctcggcggcgaccagaaaatattccaggttcagaaagttgatcattcctgccacccccccgccatcagtgcggccagcttcggaagatacggcgccagtttgtccagggaggtgttgaccaccagctcttccgggaagttcagttcctgaagcagcgcatgcgcatatctgtgattgcccacatccgtgcagaaatgagcgtcgctgtcgatgatcaccggctgctcataccggcggcacagctccagcatcacccggtaattctccggagcgcccgggcggaagccgcggggatttaaggagctgttgttcatctccaaaagcttgtgattgcgtttggccgcggaaaccagggcctcatagtccaccggataacggctgtcgtccggatgcccgatgatgtggatgtaaggattttccagggcatggatgtaagcggaggtgttctgctcccgggtgccgctctcgatgcacggcggatgcaggctggcgatgcaatagtccagccgctccaggtaatccggcggcaggtccaccgtaccctcaaaatccataatgttgagctccgcccccatcaggactttgacgccaaagagttctctggggatcaccttaaaattgatgaaatgaaacgcttcacagcttccgggcatggccggcgtgtgatcggaacagccgaagagggtcagaccggcgtccgctgcggcccgcaccatttcacagagcgaattgtaggcgtgtccgctggctgtggtgtgggtatgcaaatccaatatgtcatacatggctgcaggaatattcctttctttgctttctatataaattttcgtatctgttcagtaccttcacagatacgagcaaaaatccatttaaaatcgacttcgttgatgggatttttgccagcaagcttaggttctcatacggtcagcgcagcaagtgcgcagacctactgaacagttacaaattttcaatcaaatcataccacactttacccgcggtgaaaaggtgaatgtttgcggcatccgggacgttttaaacggtggaaaccggccccggacaggccggggggaggaaaaacggtgataatccggaaggaaattgccaaaatgtccctgaaaatgaaaaataggtataaaatttgtgagaaaactatagaaatattaggtgggttgttgttataatggagaggaatgaactcaggcgttgacgccgggtgaaatgaaaggaaaagcgaggagagaaacatgagtgaagaaatgaaaaacgagatggaacttgaaaatgcggaggcagttgaaactgcggccgagccggtagaaaccatggaagactatgcggctgagctggaggcctcttataagactctgaacaagcggaatatcgagatctccgaggacgagagcggcgtgctggagaaatgggcgcatttcacccagatgctggaggagcgcaccgtattttccgtaaagatcgccgaggcggtgaaggcaggcgttgtggcttacgtggacgacgtgcgcgcgtttatcccggcttcccagctgtccaccgagtacgtggagaagctggaggactggcagggcaagaacatcgacgtgatcgtgattaccgccgacaccgagaagaagcgcctggtgctgtccggccgcgaggttgagaaggagcgcaaggaagcggagcgcaaggagaagctggcgcagtttaaagccggcgacgtggtggagggcaccgttgacagcctgaagaactacggcgcgtttatcaagctggcagacggcgttgacgggctgctgcacgtttcccagatcagcacccagcgcatcaaacatccgggcgttgtgctgaaggaaggccagagcgtgaaggtgaagatcctgtccgttgcggacggaaagatcagcctgagcatgaaggcgctgaccgcaccggtggaggatgaggagcagcacgagcgcttcgactacaaggagacagcttccgtgaccaccggactgggggatctgttaaaaggactgaagctgtaagcaagcatagaaggagggatagcgatgtcaaatatccccaaatccgacgaccaggtggatcaatggcgttcggttatgtttttgtacgattccgccctgaagaaagtcaacactaaaattgagatattaaacaacgaattcgtgaaccgctacgactacaaccccattgagcacatcaagtcgcggcttaaaacagctgacagcattgttaaaaagcttaaaaaagacggtcacgacgtgaccattgaaaatatgatggagtatctcagcgacattgccgggattcggattatctgttcctttacctcggatatctatcagatcgcggagatgatcgcccatcaggccgacgtgacggtgctgcacgtgaaggattatatcaagaatcccaaacccaacggctacaagagctaccatatggtggtcacagtgccggtttacctgtccgacgggccggtggagacaaaggtggaagtgcagatccgttccgtggctatggacttctgggccagcctggagcacaagatcgcttataagttcgagggcaacgcgcctgagaatctgctgaaggagctgaaagcctgcgcggacatcgtggatatgctggatgccaagatgttctcgctgaacgaggctattacggcctacgcggcggagcagcggcgtcaggaagaacaggcggcgaagacggaagaagaattttcgtgaagacattttttagagagacctatcaggttttgcgggtgaacctgcgccagctggtgctgtttgaaattctgtaccggctggtggcaggcgcattctatataaggcttgtcaacctgctgcttaagatttccctgagggcggcggggtacagttatctgaccatgagcaaccttgcggcgtttctgctgcggccggtgacggtgggttgcgccatggtccttgtgcttgttggagcatttttgatggtcgtggagctgggcggactgttgaccgcctaccaggcggccgcatattcccggcggatcgacgtggtctccattgtgcggggggccgtcggcaaggcggtggacgagctgtcaaagcggaactggcagctttttttgcttgccctggccagctatctgatgatgaacagcatggtccttctgcggcttttgacccgggtcaagccggtgaacttcgtgatggccgagatctggagccagagggccggacgggccgggcttgcggcggtagtggccggtctggtggcgatcgggattcccaccatgctggtgtttttcgcgtgcatggtggagcagaaacggttccgggacggggtcaggcgcagtgtggagctggtgaaagggcgctggccgaaagccctggcgctgctgtttgggctgaacgccctgatggtggccgcctctgtggctctgcacctgctgtttgtggtggccgcggccgtgtgcgtgacgctctttgtggacagctacgcggcgatggccgtgctggccgcggtctgccgcaggctggagctggtcgtgctggccgtggccagcatggcggccgggcttgtggatttcggggcgctgaccgtggtgtattatcagtttgagacgcggcacagccaggtgaagccctgggacttttcctatgtgtgccgggatcatttgagccggaagcggattctggccgtgaccggggcggtggccggcgtcagcctgctgtttcttctggacatggtgtgcaacggttttccgctggattcatcggttctgaccgagacggagatcacggcccaccggggcagctccaagcgcgcacctgagaataccctggtggctctggagactgccatcgacgagatggcggactacgcggagattgacgtgcagaccacctcggacggcgtggtggtggtgtgccacgatctgaatttaaagcggttagccggcgtgaaccggcgcctggggagcatgacctacggcgaggtgcgggatctggatgtgggcagctggttcgggccggatttcgccggggagcaaattcccaccctggaggaggcgctggacgactgcaagggacggatcaagctgaatatcgagctcaagaacatcggggaccggacggatctgccggagcaggtggtggagatgatccgggaccgggagatgcaggagcagtgcgtaatcacctccgtgaagctggactacctggtgcgggtgaaggaggcggacccggatctgcacaccggatacattctgccggccgcctacggcagatactacgacaacgatgcatttgactttatcagtctgcgctccagctttgtgactctggggctggtggaaaacgctcatgagaagggcaaggcggttcatgtctggaccgtcaacaaaaagagcgagatcgagcagatgaaggtgcttggggtggacaacattatcaccgactatccggccctggcacgggaggtgctgtaccgggaggaggctacggagagtctgatggaatatttgaaaatggtgctgcggtgagcattgacgcaggcagagcgcggaggattgccggcgaaccgggtattgggaaaataccggccgccggcaatttggtattaaatgcaatgggccgccggcgcagcctgcgggggattgttggggacgcaagggctgccggttaattggaaaaatttgttttatattgcagggaaatcgattataatagagagaataacgggacagaccgtgggtttcagggatgaacgggcggaaatgcagcggatcagacatccgatgcaaaaattggcgcagaaagctgcttataagcgggcctgacgccgatttccacaccaatttttccgccgtctgaactgttgcatggaaagagacgggaggtgcggggatggcgatgatcggaattgatctgggaaccaccaacagcctggcgtgcgtttggagggatgggaaaccggaactggtgcccaattccctgggggaatatctgacgcccagcgcggtgtacgcggatgaacagcaggttctgtggaccggagctgtggccagagagcatatgtgcatccggccggagcggtgcgcagcctccttcaagcggcatatggggacggacaagcggattttcctggggtccatgggatttacgccccaggagctgtcctctatggttttaaaacagctgaaggaggacgccgagcagtatctgggatgcgaggtggaggaggcggtgatcagcgtgcccgcctattttaacgacgagcagcgctttgccacaaaggaagccggtgagatggcgggactcagggtggagcggctggttaatgagccgtccgccgcggctctggcttgccgcagcgagagcggggaggaggattcgtcgtttctggtggtggacttgggcggcggcacgctggatgtgtcggtggtggagtgttttgagcaggtgattgagattcaggcggtagccggggacaaccacctgggcggagacgatttcgatcatcggattgccgagcatttctgccgggagcacgggttggtgttcgagcttttgtctccgggggatcaggctgagctgctgaaaaaagcggagcagtgcaagcgggctctgaccgcgtcgtccgcgggtatgattgagttttccggggataagggaaccatgggaatgtttctgaccggagcgcagtttacggagcttagcgcgccactgttggtgcgtctggaaaaggtgctccgccaggcgctaaaggatgcggggaaaaccatgggcgatatcgatcaggtggtgctggtgggcggttcctgtaaaatgccgttggtccggcagtttatcgccaaaattctggagcgggagccgtatctgtgcggccggccggatgagatcgtggccctgggtgccgggatttacgctgggatcaagagccgccaggacgagatacgggatgtgattctgacggatatctgcccgtttacgctgggggtggggatcgtggattacgacaatcctgacgacctgatcatgtctccggtgatcgagcgcaacagcgtgcttccggtcagccgcatgcgggagtacgtgaccacggcggataaccagaggaaggtggcgtttcgcgttttccagggggaatccattcattgcagccagaaccaatatatggggacggtggagctggaggtgccgcctgctcccaagggacgggaggcggctctggtgcgcctgacctatgatatcaacgggattctggaggtggaggccatgaaccgcctggggcagagggcgggcaaggtgataatgagccggaaggttcgcatgagcgaggaggagcttaagcggcggaccgcggagctggaagccatcaagcgcagcccgcgggaggaggcggccaaccagctggtgatctcccgggcagagcggctgtacgcggaagtgctgggaaatgaccgggaggtgatttcccagcttctgcggtggttttcccagatactgggggagggcggtcctgcggcggtggcggcagcgcagaaaaaggccatggaaacgctggattatattgagcggaagctaaatggggatgtctgatgacaaacttgtggatctggaacgaattggaaattgagcccacaaacgaccggcgggccatcaagcgggcgtacgcgaagaaaagccgtctgtgccacccggaagagaagccggaggagttcaggcggcttcacgaggcgtaccggatggctctggagttggcggagcggcaggaaggcgggaaagaatggggagaactccctggggctgcctcgcccgctcatgcccctgcgcccgactaccgtcagttggacgagttgatcgcccggggactggaacaggattacgccagggacacaaagctacttttggagaagatgaagaggctccatcaggaggcgggggagaatgtcaaccgttacaccggccagatgaaaacctgcctggagcaatggcgccgcctgacggattccgagcattttcggacagcgggctggaagccggagtttctggaaatgctctcggactggctgcgggagaaccgggatagcatgaatcgggcggaggccatcagtctctataacgcctatgattttatccattatctggatcgggattttcccgatgtgccgtttatcaatgaagtttatatacagctgatgtatcaggcccgcaaatatgagcgggatatgctgcaatacagcggtctgccggttgtcgggcgcgtgaaaggccgttcccggcagcagtgcgccggaaaggcgggggccggaaggcggaatctgctttactgcctgatgtgggcgtcagtgtttttctgtttgatgatggttgtcatgttcttcatcccgggcaaggcgcgcagaacggaagagcaggtggagccaatgcgctacagcgcggttcatgaagccaaggcggaacacagcgcggggtggcttacagactatagcttctgcagcgcataccctgacggctaccgtatgtccgagcaggagattctggggcaaagaattgcctcctcggtggagggcgttgcagcggcggccactgcccgtcttcatattaacggcaaacacggccttccctacgaggtggatctggagtgtgtccgtgaggcggatggggaaaatccggctgttttccggtcgcggactcaggataaagcggatattacctattattttaccgtacagccctcggagaacggcatcctgccgcccaaagtgctcacatccggttatctcccggaggcgttccgctatttctgcgcgcagaaaaagatcaactgccgggtctggtatcccgcgtacgacgaggtcggcctggcaatcgcgtggcccgaggtggagcgcacggtatttttggagtatgccctggccgttgtgtttgaggagtacagccggtacgccggagatcaattacagcccttaaatatcacggtgatctacgggcgggatgcggacgcggctctggatgcgctggcggagggaacctacgggcaggacccggacgcagcccatccgggttattttgtgagcagcacggagggcaaaaaccagttccgtccggatcccggattcgaggacgccctgtgggtgagccgtgtggtctgcggtcctgagaagagcgagggtacggtcttgtatccgggctgcgcgcgctttgacgtcacaaaagaattgctggatcatctggaaagtctggattggatggtcaaaatgaattataataagagcggtcgacaaacaattataaaggagaacgaacaatgagagcggtaatacagcgtgtggcccatgcgggtgtgacggtggacggccaggttctgggaaaagtaggaaaaggattcctgattctgctgggcgtgtcggatgaggacacggaggaagtggccgaccggctggcggataagatctgtaagctgagaatttttgaggatgagaacggcaagaccaacctgtccctggcggatgtgggcggagagctgctggtgatcagccagtttaccctctacgcggactgcagaaaaggcaaccggcccagctttatcaaggcgggcgccccggatatggcgaaccgtctgtacgaatattttatggagcggtgcagacaatacgtgaagagagtggagcgcggggagttcggcgcggatatgaaggtggagctgctcaacgacggcccgttcacgctgatgctggacagctgtgacctgtttaaatagcggagaggaattgcgatggcaaagataatggagacagtattatattataatccgggcaccccggagacgatgaagcacgtggccaggttaaaaagcgtgctggtgcgcatgggaatccgaatccgcaacatcggcccggaccaggtgaaccagacggtggggtatctggcaggcgtccccggatttgaggaaaatgcggacgcgggccagctgccggtgatcagcgaggagatgctggtgttaaaacagttcagcagccgccgtatcgacgaacttctgctgaacctgcgcaaggcgggagttccgcgcatctccctcaaggcggtgctcacggagcacaactgcgggtggaccttctacgcgctgtacaatgagctgcgggaggagcacgagaagatgagcgccatggaggcgccgggaccggctgcgtccgcgggcgatccggaggaagcttccgcggaccaggcggcccccgcccggcccgcagagtaacccgggaggcggcccttatgattgatccaaccagagaccggcagctgcgggagctggagcaggtaaatctgtgcgcgcagatcctctaccaggccaggaatgagctctatctgaacatgcgcttcctggatattcccttgagcagcctgggatttgaggcggagtggggattgaacggaatccgcacggacggttttaatatctattacggcccggactggctgaccggactttacggtcaggggcgcgtgcgggtgaaccgcgcttatctgcacatgctgtttcactgcctgttcggacatttggacgggcggggagagcgggaaatatccgattggaatctggcctgcgacatcgccatggagtcggtgctggacgggctttaccagaagtgcacccacgtccagccgggagcgttccgccgtgagacctacctgcggatccggaaaatgttaaaccaggaagtgctgaccgctcagggcgtgtacaaggctctggtggagatgaaacccgacgaccggcgaagaggccagctgcaacgggaattttatgtggacgaccacagccgctgggaggagcctcagccgccccgccaggtcagaaaccggcagaacaagtggaaggacaaccgggagcgcatgcagaccgagatggagaccggctccaaagacgcctcggaggacaaccgaagccttttggatgagctggaggtggagaaccgggagcggtacgattaccggcagtttctccggcggttcgcggtattaaaggaggagattcaggtggatatggactccttcgactacgccttttatacctatgggctgtccctgtacgggaacatgccactggttgagcctcaggagtccagagaggtgtaccgggtggaggatttcgccgtggtgatcgacacctccatgtcctgttccggggagctggtacagcgttttttggaggagacctacgacgtgctgtcccagtcggagagcttcttccgccgggttaatgtgcacgtaatccagtgcgacgaccagatccggtccgacgtggtgatcaccagggcggaggatttgacggattatatggagcatctgaccctgaagggcctgggaggcacggatttcaggccggcctttgagtatgtgaacggtctgcgggccgcgggggcgtttgccaggctcaggggtctgatctacttcacggatggaaaagggatttatccggtgcaggctccgccttacgacacggcctttgtgttcgtcaaggaccagtacagcgacgagtcggtgccgccctgggccatgaaggtgattctggaggcggacgatctgatggagaaagggcaaaatgagccggagacagggaatatgggactgttgcagaaggaagagcaggagagaacgacatgaatataaaacgggccaaacaagagatcaaggacaccatccaggcgtatctgctgcgggatgacacgggcgcttacgcgattccgtccatccggcagcggccggtgctgttaatcggccctccgggcgtggggaaaacccagattatggaacaaatatcccaggaaatgggaatcggtctggtggcctacaccatcacccaccacacgcggcagagcgcggtggggctgccgtttattgagaaaaagcagtacggaggccgggagtacacggtgacggagtacactatgagtgagatcgtggcctccatctacgacaagatcgagtccacgggcctggccgaggggatcttgttcatcgacgagatcaactgcgtgtccgagacattggcgcccaccatgctgcagttcctgcagtgcaagaccttcggcagccaccggatcccggagggctggattatcgtgaccgccggcaatccgccggagtacaacaagtctgtccgggagttcgacgtggtgacgctggaccggatcaagaaaatcacggtggagccggattttgaggtctggaaggagtatgcctaccgggaaaatattcatccggccatcctctcttacctgggcatcaaacggcagaatttctgccagatcgagacgacggtggacgggaaacggtttgctacgccccgaggctgggaggatttgtcggaactgatctgcgtttacgagcggcttgagaagaaagcggaccgggacgtggtggggcagtatatccagttccccgccattgcaaaggatttcgccaattatctggagctttattacaaataccgggacgattaccaggtggatcaggtcctggccggagtcatcagcgaggctctgtgcgacaaggtggcgaaggccgcatttgacgaaaagctcagcgtggtttgcctgctgctgtctaagctgtccggggtgtttcgggagctacgcctgagggaacggcagatggaacttgtgatgaacgggctgaaggagttccagaagctggttgtcacggacgcgaccgcaggaggtgttgcgcatggcatggcggactgcgaaaacgtccagtctccggccgcggtcatgatgggtctggcggccaggatggagcgggagataaacgccgaccggtccgccggacttttgagccgcagggaggaggcggtgcgccggtctgccttgatggaactggaaaattatggtaaagaattggcgcagatggagtgcgcggacggtccggcggcctgggagcaggtgcgggcgcggttcggtcaggccagcgaccgctacgaggaacggcggatttcctgcggtgagatgttggagcacgccttcgatttcctggaggcggccttcggggacagccaggagatggtcatttttgtgaccgagctgaataccaatgaatattgcgtccgctttttacaggagtatgagtgcgagcggtattaccagtacaataaacggcttttgttcgacgatgaggagcagaggttgagagcgcggatttgagagacggaaaggaaaacgttggatgaaacacatattaaaaaacgacagaaatcaggtccggtggggatataagctcatgtcctttgttctgatccaggagatctttgtgccgatcgccatagtgctgttttccgtggctctggtaaatctgctgtttccggttttacaggcgtccggggtgttggacggcgacggcgtgctgcgggcggagtatcaagaggttttccagaacggttggtttatcgcggggatgatcgtacagaacctgttgatgtgcctgttttttctgggggcgtggaaatatctgcttcacggcagcgcgcgctccatgggacttgcgggcagggaatggctaaagcagctgggcgtgggttttgccatcggggtggtgatgattaccattgtctgcggcgggatttatctgaccggcagcgcccaggtaatgaacggatcgggcctgcatttcagcccgtggctggcaggttatctgctcgtgttcgtgtttgtggggtttggagaggagatcgcgttccgcggttatgccatgggaacgctgcggcagacggaaaaggactggcttatggtgcttttacccgccgtgctgttcgggattgcccacagtaccaatgccaatttcagcctgatgggctgcggaaacattatcctggccgggattctgctggggcttctggccttaaagagcggacagctctggctgggaatcggatttcacatctcctggaactttttccagggctgcgtgttcggtttcggcgttagcggtatcagcacgcccagtgtggcggtgacggagctgaccggctcttcgctattaaacggcggggcattcgggccggagggcagtattgtggccacggtggtgctcctggcggcaatcgctgcgacgctctggtggttcagagggaaacaggggtcggggaagtaagaaaaagggggggaatatatgctgtacgggaaattgctgcgttttacataccgcctggaacggaatccggtgtttgcttcggtcaaacgcggtttgctgctgctgacgccggtgctgatcgtgggagcggtggccctgatgctgcggaaccttcccattcccggattccaggagtggattacggcggcggcgggcggggcggtttacagcactcttgggttcatctacgacgccaccatcggcatcatgtccttgtgtctgctgtgcggtatcagctattcttatgccgcgaccatttccgggtccgacaagacgttctgcctggtggcggttatggcctctcttggaagctttttcatcctgttcagcgcgcagagcagcggcgtgtttgagttcgccagcctgggcgcggtcagcatgttcggggccattttgtgttccgttgcggccacggcgctgttcggcgcgttcagccgttatctgccggcccgcctccgctcctacagcgcgggcatggacgtgcagtttcgggtgtcggtttccctgatcgtgccgctgtgcctgtgtctgctggtctttgctctggcggggctggcgatggaacagtttctgggggttggaagcatcaatgaactgctctcgggcggaatgatggccctattccaaaatgtgcccaacgagctgggcaagggcgtgctgtttgtggttctgaccgaccttctgtggctgttcggcatccatgggggaaatgtgatggagccggtggcgcaggcctatttcgccaccctggaccagaacggcagcgccattgtctgcaaatcctttgtggataatttcgcgcttatcggcggaagcggggcgacgctgtgcctgctgctggccctgctgctgttctcgcggtcccacgagaaccggcggctggcatggtgctcgctgcccttcggggtgttcaatatgaacgagccgctggtgttcggattcccggtgattttaaatccaatcctctttctgccgtttctcctggtgcctgtgatctcgctgctcatcgggtacgctgccacggcctgcggatttatgccggtggtgaccaccacggtgacctggacgactccggcgcccctcagcggatacgccgcaacccactccgtaaacggtgccctggtacaggcggtgattgtggcggcgggtacggcggtttacgcgccatttgtgcgcctttccgagcacatgcagcaggagcggatccggattgacctggaggacttgctgagggtgtttgcggaggagagcgagctgccggccctgggaaaccaatttctggagcggtccgataatgtaggcgcggtggccaaggtggtggtggaacagtttagccgggatttgcggtcagggagtataccggtgttctaccagccgcaggtggacgagttcggcggggtctgcggggtggaagccctgctgcgctggagattccggggcaagccgctgccgcctccgctggtgatcaagctggccagggaggcgggaatctatggggacctgaccgactgcatcctggatacggcggtggcggacagcgcccgcttccggaacgccctgggccggcctctcatggtgtcggtgaacatttccccttatgaggcaaatgacgaggcgtttgtccgcaaggcggttcgcctggttgaggaggccgggctccaaaacagcttctgcctggaggtgacggaggaggccgcactggaacggtttggaaaaatcgcggaaaatctgcacgatcttttcgggcacggcatcctggcggctatcgatgatttcagtatgggccagacgtcccttaaatatctccaggggagcaatttccagtttgtaaagctggacggcgctcttgtgcgccagctccttgacagcccgcgcagtcaggatatcgtgcgcgccatcgtgggattggggcaggatttgaactttcaggtggtggcggagtatgtggagagccgggagcttcgggacctgctgctctcgctgaactgccgcattttccaggggtatctctacagccccgcggtgccacccgccgagctggtccgctttgtgctggatcgggacagcgcgcggcagcgtccggtggccgggtcataagtcagcgccgtttccagcgcaacgtgttgtcggtaaattccgcttccagctccccgctgtcgtggagccaggacagataggagcggaccgtgctgcccaccagcacgtgctgctcaaagttcatggtcaggccgtaggagtcgaatacatgttttaagaccgcttcggaggaggcgggggtccggcagaatgtgcagatgaggtccgcaatttggcggacctttttgcggtttaggtccaccagcggtccgatgtcgtccgtggcctccgcgtgggaggggacgaacaggcggccttccatgcgggctaccgcgtccagggtatccaggtaggcggccacgtcgtagatgaaggagacgtggtatttttccagggtggcagcactgctcaggcagtccgccagaaatacggtgtcatccggcgtccgaaacccgtacatctggaagaaatggccgggcagagggatgaccttaaggccgctgggaaagtccgggtccgagaaggggactatgctgctgggctgggccatgagaaatttgtggcgcagcgcccctgccggaaaaccgccgtacaggaaggccggttccaggatggggctttcggtgaaatgcccctcgattccctcggcaaagattttacagccggttttctgctggataaaatggtttccgccgatgtggtccgcgttggagtgggtgttgacgatgcccgtaagctgccatccgcgctgttccaggatccgcaggagcttgcgtcccgcgtccttgtcgtttccgctgtcgatcaggcagacctggccgtcccctgagcagtagatgccgatttttgccggtgcgttgacatagtagctgcaatctccggcctgagtcagttcaaacatagaaaagccctccttatatggtgcggtgtgttctggatttgtttaaattataccacgccgcccagccgttgtcccgctgcggatctgcatatttcccgtatgtttcggacgaattattcatcaatatagcgccaattctaaaatattcagaaagaatttggtaggtattgaaaagtcagccacaatatggcatactgataataacaaaaaaggggtagacagcgccggggattcagggcgctgttgtttctatttagactttagaaaggagaacttatgattaacaaattctgtaaaacgccattgtgggaggcaacgatgacgctggccgccacggcagagggaaggattccggctgagacggtgatccgggatgccaggctggtgaatgtgtgcaccggtgagattatggagcacacggacgtagccattgcccaggggaggatcgctctggtgggagatggctcccactgcatcgggccggacacccgggtgatcgaggctgagggccagtacatagcgccgggatttttggacggccacatccatgtggagtcttccatgatgggcgtgggggagtatgccagggcggtgatcccccacggcaccgtgggcatttatatggacccccacgagatctgcaacgtgctggggctggagggcgttaagtgtatggcgcaggatgcggccagaacgccccttaaagccatgatcaccaccccgtcctgcgtgcccgcagttcccgggttcgaggacaccggctcggccatcggtccggaggacgtggagggaaccatgtactgggacagcgttgtgggcctgggcgaaatgatgaattttccgggtattttaaactccgacgagcgcacccacaagatcgtgggggccaccctgagagcgggaaagatcgtcaccggccactactccatgcccgagactggaaaaggcttaaacgcctacatcgcctccggaacccgctgctgtcatgagtccacccgggccgaggacgccctggccaaaatgcgcctggggatgtacgcccaactgcgggaaggctccgcctggcacgacctgcaccaggtggcaaaggccattacggagcacaaggtggacacccggttcgcctgcctggtatccgacgacgcccacccggagactctgatccaggaaggccatctggaccacatcatgcgccgggcattgcaggagggcatcgaccccgtcacggcgatccagatggtgaccatcaactgcgcccagtgcttccagatggaccacgagctgggttccatcgcgccgggaaagtgcgcggacatcgtgttcctcaacaacctggaggagctcagggtgacccgggtgctgatcgacggcgacgtggtggcggaggacgggaagatgaccgttccctttaagccttattcctaccccgcctgggcgatggattccgtgcacgtcggcggctccatcactccggattccttccggctgaatgcgccgggaaccggggagggcgcccctttggccgacggaagccgggtaaaggtgcaggtgatcgaggtgggctccggcaaggtggccgacattgcgggcacggcgcttctgaccgtggcggaggggcaggtacactccgatgtggagcaggacgtattgaagaccgcggtgtttgagcgacatcacgagacaggcaaagtgggcttcggcttctgtaagggctttggcatccgctgcggcgcaatggcctccaccgttgcccacgatgcccacaatctgctggtggtgggaaccaacgacgcggatatggcgctggcggccaataccctgatcgagagcaagggcggcatggccgtggtgcagaacggccgggttctgggcgtggtgcctcttcccatcgccgggctgatgaacgacaagccggcggaggagatggccgccatggtgagccgtctgacggagtgctgggagcagatcggctgcaccatggtttcgccgtttatgaccatggccctgattcccttggcctgtctgccggagctgcggctcacggaccgggggctggtggactgccggaccttccagtttacgcctctgtttgtggacggggcggagaacgcctgatggcggcagagcgcgtgaccgggccctggctgtcccgggagccggagacggtctcccgggaactggattaccttctggattgcgtccgcgaggaggaatgcgtgcgggatctgcggtttaacgggctggcggccggggaggaatccctgcggctgctggccgccgtccagtgcctgtttgtaaattgcagctttcagagctgttcctttgagcagagttcatttgtggacacggtgtttcagtcctgcgatttttccaactgcgatttcagcgacagctttttcaaccgctgtgagttcaggaactgcaaggggcttgggaccaagtttgcgggcagcacggtgaagaatctgaccttggccggctgcgctatggatttcgccaacttcgacgcctgccgtctggagcgcgtctgcgtttcagaaagccgcctgaagggggccgtgttcagccaatgccgcgccaaggatgtttactgggaccgggttgacctgaccggggccagcttttttaggacgccccttcggggaatggactttaccaccagccagatcggaagcctggtattgtccgacggctgcgaggagctgcgcgggcttacggtggatctttaccaggcggcggagctgtcaaaacggctgggcctgatgattaaataatccttttttggataaaatgctgattgacgcagaatggtgttatgcattagtcttttatataacacattctgcgtttggctttttttgagccgcagtttctgaaggggacgtggaaacgcttttatcatgggatattatgatatataatagaaagagagaaggatgttcaaccgattttgaaatgttccgggaagggggatttaggaatgaagatcacgtatattcaccacagttcatttctggtggaaatggaccaggcggcgtttctgttcgactattttgaggggcagctgccggagattctcgacaaaccgctggtgattttttccagtcatcgccatggagaccatttctctccggtgatttttgagctggcggaccaggcggaacaggtggtatatgtcctcagcgacgatatctggcgcaagcgggcgcctcaggagctgcgccgccggattctgtttatggggccggacgaggaggcttccatcaatctcccgcccgcgattcacgtgcggaccatgaagtccacggacgagggcgtggcctttctggtggagtgcgggggcaaacggatttaccacgcgggcgatctgaacgactgggtgtggtccggcgagccggaggccgacaatctgcgcatgagtgaaaattacaaccgggagctggagaagatgaaaggcaaccacgtggacgtggccttcgtacccctggacccgcgccaggagggcgatttttaccggggtatggacggctttatgcgcacggtgggcgcggatgtggtattccccatgcatttctggggagactttactgtggcggacaagctgaaacagctggagtgctctgcggattaccgcggcagggtgatggaaatccaccgctgcggcgaggagtttgtgatttaatatggggcggaaaagccgcatagggaaaggatggaagaacattatgatattgattcgcggcggacgcatggtggacccggcgacgggcagagatgagcgggccgatttggtattggagggcggagtgatccgggaaatctgcgcgcccggccaggcggcggagacggattttgaccaggtgatcgatgcaaaaaacctggtggctgcgccggggcttgtggacgttcacgtgcatttccgggatccgggactgacctacaaggaggacattcactcgggagcccgggctgcggccagaggcggcttcaccacggtggtgtgcatggcgaataccaaacctattgtggacaatgaggagacgctgcgttacgttctcgcggagggcaaaaagaccggcatccacgtgttgagctgcgccgctgtttccaggggctttgagggccgggagctgacggacatggagggccttctggccgccggagccgccggattcacggacgacgggattccgctgatggacggtgtgtttgtcaagaaggcgatggaagaggcggcccgtctggacacggtgctgagcttccacgaggaggacaagagctttattgtcaacaacggcatcaaccatggggccgtgtcggaccggctggggatttacggctccccggcgcttgccgaggacgcgctggtggccagggactgcatgatcgcgctggagaccggagcgaaggtggacatccagcacatcagctccgggcacgcggtcagaatggtccggctggccaaggacctgggcgcaaatgtgtgggccgaggtgacgccccaccatttcgcgctgaccgaggaagcggtgctcaaatacggcacgttggccaagatgaatccgcccctgcggaccgaaaccgaccgcgcgatgctgatcgaggggctgaaggacggcaccattgacatgatcgccacggaccacgcgccccacagcgcggaggagaaggccagaccgctgacggaggcgcccagcgggatcatcggcctggagaccgccctggcgctgggaatcacctgcctggtgaagcccggacatctgagtctgtgcgaactgatgaagaagatgagcttcaatcctgcccggctctacaagctggactgcggccgcctggaagccggagctccggcggatctggtgctgttcgatgagaacgaggagtggacggtaacggatttcgcctccagggcggccaacagcccctttgtgggggaacggctcaccggccgtgtgaagtacacgatctgtgagggaaaggtggtataccaggatagatgacaggcgagagaaaatatgacgtgatcctgctggacgtggacggcacgctgctgaatttcgaccaggcagaggcggacgggatgcgggtagtgctgcgggaatacgggttcgaaccgacagaggagcttttggaggcctaccaccaggtgaataacgtgtactgggcggcctttgagcggggcgaggtgaccaaggaacggctggtctgccagcggttcgagacatttttcgggagtctcggcaagaccgtggacggcgctcaggtggagagcctgtaccgcaggcagctggacggctccgctatcctgatcgacggggcggtggagatctgcggatatttgcgggatcggtacgatctgtatatcgtgaccaacggaacctcgtccacccagtacaagcggctggcagcctccgggttggatctgtatgtgaaagacattttcgtgtccgaggacgcggggagccagaagccccagaaggagtatttcgactactgcttttcaaggattcccggcgcggacccctcccggatgctgttggtgggggactcgctgcactccgacatactggggggaaatgtggccggcaccgacacctgctggtataatcccaaggggaaggcgggagaaagcgggatccgggtggactatgagatatgggatttgagggaattggaaaaaattgtataatcggttcgatgccgcacggcagctttccatccgggagagctgccgtttgatttggaaaggctgaagtgccggcgtatgccgaagcgggttgggagctgtaaatctataaaatatttctcaaattctactttacttatacactttagtatgctactatggtagagtgattttcgaataaagtatcagacccatgaaatcatgttttgaggaggatcagtattatgaaaaagaaaacattttgcctggctatggcggctgtgatggcttttgggctggcaggctgcggcggcgcggaaaccaagggagaagccgctacaacagttgagagtacggcggatactactgcggcggacaccactgcggcggatacggcagcggacacttctgcggctgagagcgagacttccgcggaggcccaggctgcgggcggacattttatcgtaggatttgaccaggagttcccgcccatgggattcatgggggataacggggaatacaccggatttgacctggagctggcccaggaggtcgccaaacgcctgggactggaataccagccgcagcccgttatctgggataccaaggacatggagctggattccggaaatatcgactgtatctggaacggcttcaccatgacgggccgtgagagcgattatgagtggacggaagcctacatggccaactcccaggtgtttgtggtcgcagcggattccggtatcgcgtccatggacgacctaaagggcaaggttgtggagtgccaggccgattcctccgctctggcggcgctgaatgaaaacccggacctgacggccacttttaaagagcttgtgaccacggcggattacaactccgcgtttatggacctggagcagggcgcggtggacgccatcgccatggacgtgatcgtggcggggtaccagattcagcagaggaacgccgattttgtgatcctggaggaccacctttccgctgaggagtacggcgttggctttaagaagggcaacacggagctgcgcgacaaggttcagaagactctggaggaaatggctcaggacggcaccttaaaggcgatctccgagaagtggttcggcgaggacgtgaccaccatcggcaagtaaacaattcatattccgaaagccgctgcatgtttaaccgtacagcggttttctccgcgctggggggcggggcccggcccgcgcgattttaaggtgcttcggcgattgccgggggaaagcggtccgggaccggcgggagtaggccgggcatcagggagcgctaaacgtatagaaaaggcggtagatcattatggggaaaatgacggttgaacagattctgatccagctcatggggggaatgctgaccagcgtacagatattcgtggtgacgctggtattttcgctgcctctgggcctggtggtcgccttcgggcggatgtccgcgaaccgtgtggtccgcaccattgtgaaggggtacatctcggttatgcgcggcacgccgctgatgctgcagctgatggtggtgtatttcgggccttactatattttcgggctgaagctgggcagcggctaccgcctttgggccgcgctgatcggatttgtgatcaactacgccgcctatttcgcggagatttaccgcagcggcatccagtccatgccccagggccagtatgaggcggccaagatcctgggctacagcagaggacagacctttttcaagattatcctgccccaggtgatcaagcggattctgccgtccgtgaccaacgaggtcatcaccctggtgaaggatacctccctggcgtttaccctgagcgttatggagatgttttccatcgctaagatgctggcggcgtcccagagcaacatgattccgtttatcgcggcgggcctgttctactacgtgttcaacctgattgtggccctggccatggaagggcttgagaagaagctgaattattaccagtaaggggaaggagtttggggacaatgaatcttttggagatcaatcatgtggaaaaagccttcgacgggctgggcgtgcttaaggatatctccctgaccgtgggggaaggcgaaatcgtgtccataatcgggccctccggctccggaaagtccactctgctgcgctgcgccactatgctggaaaccatggacagtggggaggtcatttacctggggaaaaaagcggcctggaccggcgcggacggtaaggccgtgtacgcgggcaggaaggagctgcgggagatccagagccagtatggcctggtgtttcagaatttcaacctgtttccccactattccgtgatgaagaacatcaccgacgcgcccatccatgtgcagaagcgggagaaggaaattgtctaccgggaggcccgggaactgctgcgtaaaatgggactggaggacaaggaaaacgcctatccctgccagctctccggcggacagtgccagcgggtggccatcgccagagcgctggcgttaaacccaaagattctgttttttgacgagcccacctcggccctggacccggagctgaccggagaggtgttaaaggtgatcaaatccctggcggacctggatatcgccatggtgatcgtcacccatgagatggcctttgcccgggatatctccgaccgggtgattttcatggcggacggcgttatcgtggagcaggggacgccggagcaggtattcgcctcggacaacgagcggactcagagctttttggggcggtatggggagatgctgcagaggggataactgaatcaactgaaaatgacttttagcgggagggtattccgtagggcagcgcggctgtctgtgcggaataccctccttttttgcgcacaaaattgacggaaaccggtgcggtgcagcgcgaggttctgtgcatgtgcgtcagcggtccataggcggcagccttgtctgaaactataaatgtgaataaaaaatatcgttaattttaaaattagtattgcatttctgataataaagtggtataaaaaatctaagtggattatctgctataccacatataccaatttgcgcaaaccggtatgaagatggagagatgaataggaggaagcgatatgagtttgttacaagcgatactgatcggctgtgtggcggcgctgacccagttggaagggggttggctgggggaatgcaagctccgtgagcccatcgtgacgggatttctggtcggtctgattctgggggatgtgaagcaggggctgatgatcggcgcgacgctgcagttgatgtggatgggagccacgggcatcggcccaacggctcagttggatattggtaccggcggaaccattggaaccgcggtggcgctgctgaccggcaccggcgctgagagcgccattctcttcggcgttcccgtggccgtgatcatgcagtttttgaacactctgctgttgtccgcgtactcgggcgctatgctggttgcggaccgcaagatcgacgagctgaattttaagagcgtgaacgccgtccattatctctgcggtttcggcacgtttctcttgtatttcggcctgacctttatcgtgatgtacttcggaaaccatatgatcgagggcattgtaaacggtcttccggcctggatgaacgcgggcctgaccggcgtagcggctattctcccctgcctgggctttgcgctgctgctcaacatcattatggaaaagaacctgattccgtattttatcctgggcttcatccccgcggcttacgtgggctttgacctgaccatggttgcgatcgcaggtatcgcggttgcggttgcgtggatcatctttatgctgcggcagaacgagggaaccagggccgccgctgcggcgtccagtgtggaagacgagtgggaggattaaacgatggcgaaaaatgagataatcagtgcggaaaataatctgacgaagaaagattttgtaggcgttttctggcgcagctttaccttgctggggtcctttaactacgagcggatggaggggctgggtttcctctacgcggtgatgccggtgctgcgcaagatctataaaggggacgacgaggcgttaaaagccgcaatgcaccgccatatcgcagccttcaacatgaccgtggcgccctcgccctttgtcatgggcaccaccatcgccatggaggagaaggctaagcgggacaagacctttgacgtggcctccatcaacgccatcaaggtatccctgatgggcccgctgtccggaatcggagacaccttcttctggggcatcttccggattctggcctgcgccctggcggtgggctttgccaaggaggggaatatcctggcgccctttgtgctgctgctgttcttcaatattcccaacttcctgacccgttggttcggattgttcatcggctaccgtcaggggcattccctgctgtcggagatgcaggccacgggccgcgtgcagctgtttacccactgcgcgggtatcatcggagctatgtccatcggctgtatgatcgccatgtgggtgagcatctcctgccccctgcagttcaccatcgcgggaagcgagatcgtgctccaggagtacttagaccagcttcttcccaagctgctgccgctggcctttaccctgggcattttcgcctgcatcaagaagaaaatgaaagtgaccgccatcatcggcggaatcgtggtggtcggctttatcctgggtattctgggactgatcgcaatgtaaggaggacgtagtatggctattttggatgtgagaattgacgaccggctgattcacggccaggtgtgcgggttttggattccccactactccctggagcgcatcgccatcgtggacgatgagattgtaaacgacgagatccgcaagactgctctgaagttcggctgcccggaaaagtgcaagttgtccattttcagcacggtcaaggcggcggataagtttatccgcaagatcgacgagggcatccgggtgatgatcctgtgcaacagcccggtgccgattttaaagatggcacagctgggctacaaagcgccctttgtcacggtgggcaacatgtccaccaaaccgggagccatccagatccgcaagacggtgtttgtgtcgccggaggaaaaggcggcgtttgcggagctggtggagatgggaattcctgtttattcccagatggttcccaatgaggcgagggaggacatttccgaacttttaagaaattaatgtaaattcagatatcaacggtccggcggccgctgccggcgcgccgggccggacccatcagaggaggagaacaacatgcagcagacggtacttgacaacatcaggttccagccccaggtattgccccaggtgctggagaatcaggcagtttttgtggagccatttgtggagctgttccgcaaacacgatattaaacggatctatttctttggttccggcacctcttacaacgtgtcgcagattgcggcctactatttcaaacacattgtggggatcgagggaatcgcccagtaccccacggtatttaaaaactatgagaaagcggactggacgggacttctgcgaaacgatcagattctgttcgtgggcatcagccagtccggcacctcggtgtccacctgcgaggtgatggcccatgccaaggcaaacggttaccccaccctggccctgacgggaaatctggagagcgagatcaccaaacacgtggacaccgcagtccacctgctggtgggcgaggagctgacccctccggagactaaagggtatacggtttccgtgctgagcgcttacctgtgggccgtaggcgtagcccgggacaagggcgtctattctgaggatgagtaccagaccgcgattcgggagacaaaggagctggtggacaatttccagaccgtgatcgaggagagcgaagcgtggtacgatcgcaaccgtgcttccattgtgaacagcgaccggctgtttgtgctgggctacggcatcgactacggctccatgctggagggcatgctgaaggtgggggagatgctccgcctgcccaccatcggatatgagatcgaggagtattcccatgggccgacgatggcgcttaagcccaaccaaaccctgtttatgatcggttcggacgaggcggagttcgagcgcatgctgcagtttcgggccgcattcaagaagtataccgaccgggttcacgtgatcacctgccgggagatcgagggcgacagccgggatctggtgtttgggatcaaggccaacaagtttatcgcgcctctgatgtacacggttccgttccagtttgtggcggccaagggcgccaaagatattttcatcgacaccaatatcaacccctttgatgagccgctggcccactatccggacggggaataggattcgatcgcgcggtatttccgggccgcccgcccctgcttttgtgagggcggccggccggacgccgggtgcaggaggataaaagatgatcggaattttagtcacaggccacggcagatttgccaccggtatcaccagcgctctggaactggtgctggggaaacaggagtgcttcgaggcggtggattttccggacggggacactaagacggagctggagcggaatatggacgaggcgttaaagcgcctggaagggacggagcacattctggcgttctgcgacattctcagcggttcgcccttcaacacgctgatcgaccgggccatgcgccggggcggcatcaccgtgtactacgggacaaacgtggcgatgctgttggacaccacgctgaaccggaatttcggcaagagcctggaggagctgaacgcggatatcgtggacaagggccggagccaggtgggacggtttgacgcgggcggcgtggaggaggatgacgactcattttagacaatatgggcggcgctgcggccgtgaaaggggagtttatgggtttcaaagcagtgatttttgatatggacggggttctgatcgacagcgaatatctgtacctgaccggaatccaccgggagctgcaaaaaaaacggccctgggtccgggaggaggacttatacccgtccgttggaatggacagcgccaggaaccgggaactgatgcacagggtggcaagagagccccttgacaatctggagttcgaccgggagctggaagaaatttacagtctctttgacgacgtgtgttaccgggatattctgtacccggaggtgccagatgtgctgagacgcctgcgggagatggggtttaagacagcgctggcttcctccaccggtatggagggaatccggaaggtgctgaggcagtgcgggatcggggagctgttcgattatgtggtcagcggggaacagtttcgggagagcaaacccaatccggagatttatctgaccgcaatggcggcgctgggctgccgggccggtgaatgtctggtggtggaggattccacctacggggtgaccgccggagtggccgctggggcctgcgtggcagccaggcgggacagccggtttccctttgaccagaccggagcggcgtatcgggtcgattcgctgaccgagatactggaactgcccggaatcgcgggacaaaatgacgcggcgctgtgaacgcaagattcacggcgtcgttttgtgttttgcaagagaatttgccgttcttgcattggccggtttattgtgttatgatttggacagactgaaaatggaacggaacagggggagctatggaacagggaaatcgatacatattaagggatatggaacggttcgagccgatcacggccacgctggaatccagaaaattccggtcggaataccgtgtgctggatatggaggtcacggagtccaaccgctatatcagccagaagctgaagattcccattgcctcgcggattttttatttccggaaattgcggcttgtggacggggttcccaagtcgattgaaaagacccatattctctatgacaaggttaagggcgtggagagtgcggatttggggaagcagtcgttttacaagacattacaggaaatgttcggttatgtgacccgcagaagcgaggaggagatcctgattgtggcggccggggagaaggaaaaggagctgctgggctgcggggacggggaactgatgatgatcaagggaatcacctacaaggaagagccggagcccttcgagtattttgagattgtggcggtctcggatctctatgaattcaggagtgttaccagactatgattgaatacgatgcgatatatgtgcagttgatgaagagcctgaaggagaagatgatccacggggagtaccggatcggggacaagctggactcggagcgggtgatggccgcccagtacgggatcaaccggatgaccgtgcgcaacgccttaaaggctctggaggaggaaggttacgtgaaagcttaccggggaaggggcacctttgtggccaggattcccgaggagcccagccggaagatcgagatcggcgcggattccggggcagtgatcagtttgagccgcggcatccgccagcggggctaccggtccagccgggatgtgatcagctttgagaaatgtccggcggagggggagatcaaggaaatgtttccctacaccagccatgtctttgtcatgcttcgcctttccaagatcaacgacagaccctacgcggtgcagaaaacctacattcccgcggaggttttctgggatgcggaccggtatgatttcgcggagggttccctgtacgattacatggacaccaaggaccgctaccccgcggaggtggagtcctacctgcgcatcgacctgccgcccgcggagtacgcgcagctgttagacaatccgccggataagaaggtgtttgcggtcacgtacctggcctatgaccgccaggggctgatgatcgagtacaccctgtcctaccatttgccccagtacacgtccttcacttacgttacggaacgcaaaatttgagtctctttgcagaaaacgcggaattcagggcatactataaagaaattggaagcttcggggataccgaagtggaaaaggagtttatagtatggatctttcgcccaggatggcccggttgattctgcttctgtatctgcgttttctgccggggatattccttcacaaagctttaagggaaatttccttgttttttagaaagcttaatggtaagcttcataagtaacaagtttgctgcggttcgccggttatagtccgtcggaaggtttttgcgggcgggacggaaggcgcggccccgggaattggggggcgctgatggagccggggcgcaatatgaaatggatggaaacggaggaattgaacaatgaagagacgttcatggatgatagcaacagcggcagtgctggcggcggtgcttttggcggcgggctgctcgaagaaaccggcggcggagacggcgccgtccgccactgagaccaccgcggcccagaccacggaggcggctgctgagccggagaccacggaagcctccaccgaggcggatggggaggcggtggatctgaccaaccgctatcatatgctccagggcacggtggtgaagatcacggaggacggctccgttttcaccctgcaggcggacgacggccagaactatgatctcaagctggcacagattcgggatgtggaggtagagatacaggaggacgtgcagatcgcgatcgcctacattggcaaggagatcggcaagggcggcgtgaagccggaggacacggatctggtggtggccctgccggaacaggaggagtggaccgtctaccaggagactggaaccacgatgtttaacgccatgagcagctttacggttaagaccgacgacaaccgggagctgagcctgttaaaggataactgccctatggaggagggcgccctgacgaaggacagcggggaccgcgtgatggtggcttatgtgacttctggggggaccaattaccccgttgaggtgagaaaaggggagtgagagcggaaattcgatccgcgcgctgaattggaatgggaaatttccgaaaaacccttgcaaattaagcgttttccctgtacaatctgatattgacgagaagaggggccggcagaccccttttttcatgagagcacagacgcgtacctgaaaatggccggccgggaccgcagggcatttttggacggcgcggggaaacggttgaaaaacagacaaaaggaaaggtaagtattatgattagtgcaaacaacatatccctcagggtggggaaaaaggcattgtttgaggatgtgaacatcaagttcaccgagggcaactgctacggcctgatcggagccaacggcgccggcaagtccacatttttgagaattctgtccggtaagctggagccgaccagcggcgagatcgccatcacgccgggacagcgtctctcctttcttcagcaggaccactttaaatacgacgagtacacggttctggacacggtgattatgggcaacgcccggctgtaccagatcatgaaggagaaggaagccatctacatgaaggaggactttaccgaggaggacggcgtgaaggccgccgagctggagggtgagttcgccaccatgaacggctgggaggcggagtccgacgctgagaacctgttaaatggccttggaatcgagacagacctgcactacgcccagatgaataccctgaccggcgctcagaaggtgaaggtgctgctggcccaggctttgttcggcaacccggacatcctgctgctcgacgagccgaccaaccatctggatctggatgccatcgcctggctggaggagttcctgattaattttgagaacacggtgattgtggtatcccatgaccgttacttcctgaacaaggtgtgtacgcagatcgcggacatcgactacggcaagatccagctgtacgccggaaactacgatttctgggtggagtccagccagctgatcgtgaagcagatgaaggaggccaaccgcaagaaggaggagaagatcaaggagctgcaggagttcatccagcgcttctccgccaacgcttccaagtccaagcaggccacctcccgtaagcgcgctctggagaaaatcgagctggacgacatccgtccctccagccgtaaatacccctatatcgacttccgccctgcccgcgagatcggaaacgaggttctgaccgtggagcacatgagcaagaccatcgacggcgagaaggttctggacgatatttctttcatcctgggccgtgaggacaaggtagctctggtaggccccaacgagcgggccaagacggtgctgttcaagatcctgtccggggagatggagccggacgagggcaattacaagtgggggctgaccaccagccaggcgtatttccccaaggacaacagcgcggagttcgacaacgacgacaccattgcggactggctgacccagtattccccggagaaggacgtgacctatgtccgcggcttcctgggccgtatgctgtttgccggcgaggacggcgtgaagaaggtgcgcgtgctgtccggaggcgagaaggtgcgctgcatgctgtccaagctgatgatttccggcgcaaacgtgctgctgttggatgagcctacggaccacctggacatggagagcatcgacgccctgaaccgcggtatgatcaagttcccgggcgtgctgatcttctcatcccgtgaccaccagatcgtgcagaccacggccaaccggatcatggagatcataaacggcaagctgatcgataagatcactacctacgacgagtatctggagagcgacgagatggctcgtaagcgctttacctttaccgttaccgaaagtgaagaagcggacgattgatgaatttttggcagcgggggctttgtttcccgctgcttttgagtcgatgagatgcggagcaggcgggagctggctgcggcggggcggtgaacggatgaaacgggcggcgctttaggcggctgggcggcgtgacgcccctgcatagggacgattgatttggaggaaaataatatggagaagattgcaagttttaccatcgaccacatccggctgcagccgggtctgtacgtgtcccgcaaggacaaggtgggcgaaaacgttgtgactacctttgatctgcgcatgacctcccccaacgaggagccggtgatgaacacggcggagatgcacaccatcgagcatctgggggccacatttttgcggaaccgggacgatttcggggataagaccccgtatttcggtcccatgggctgccggaccgggttttatctgctgctggccggggactatgattcccgggaggcgctgcctcttgtgacggaaatgtaccggtttatccgggatttccggggcgaggtgccgggagcggcggctaaggactgcggcaactatctggacatgaacctggggatggccaattacctggccgggaagtatttagatgtgctggagcacatcgacgagttcccgcagtccaggctggtttacccggaataggaggaaagacgggatgaaaaaactgatttcgtggaatgtcaacggcctgcgggcctgcgtgggcaagggttttctggactattttaaggaagcggacgcggatgtgttctgcctgcaggagaccaagcttcaggaagggcagatcgatttggacctgccggggtatcaccaatattggaactatgcccggaagaaggggtattccggcactgccatgtttacgaaggaggagccggtcagcgtgcgctacggccttgggatcgaggagcacgacatggagggccgggtgatcgcggcggagttcccggagtatttcgtggtgacctgctatacgcccaactcccaggacgggctggcccgtctggactaccggatggagtgggaaaatgcgtttttggcgtatttgaaaaagctggaggaggagaagccggtgatcttctgtggggacctgaatgtggcccacaaggagatcgatctgaagaacccgaagagcaaccggaaaaacgcgggcttcaccgacgaggagcgcgggaagtttacggatcttttaggagccggatttatcgacacattccggtatttttatccggaccgggaggggatttactcctggtggtcctaccgtttctccgccagggcgaagaacgcggggtggcgcatcgactacttctgtgcctcggagcgtctgaaggaccggctggtcagcgcggatatccatacggaggtgatggggtccgaccattgtccggtggagttggtgattgagtagaatttgagagatatttgagcgaaaaatgagagaaggcggagcgctgctgcggctgagatgggggactggagagttggagtgtcctgggaagctggggtggcgggacgccttttttgtttttgggatggtgggcgggattggggggaaatgcgggttgcgggggctgagggagtgtgataatatagaaataccctttcgcgagaaggggttgacgagtcgggagagttcttctcctgccggttcagggcgtttcgccagggaatccatttgttggaatttgaaaattgggaagcggggagtgatgcgtttgattgggcgatagagccgcgcagcggcatttaaaatatttgaacgtttgcgcaagaaaaattggacatgtaccacggcattcgctatactgatgttaaaaggcagaaaccttaggagggaatacgcaatggccgtgtatatgggagaggaagaggtaatacaaaagaatatggcactggcacaggaaaaggtgtacacagtggaggatattgaggcgctgcctgagggcgtgcgcgcggagttgatcgacgggcagatgttctatatggcgacgccgtcgcggaagcatcaggggctggttggaaatttgtttggagaaatatttgctcatttgaaccagaacaaagggaaatgcgcggtatatccggctccgtttgccgtatatctgaatgaggacaaccggacctacctggaacctgatataaccgtagtctgcgaccgcgacaagctggatgaggacggctgccatggagcgccggattttgtggcggaaatcctatcgcccagcagccggagccgtgactgcctgctgaaactgatccgctaccgggaagccggggtacgcgaatactggatcgtggacccggagcgggagacggtgacggtgtatgactttgcggagaataaggtggggagttatacgtttcgggataaagtgagagtgaatttattcccgggtctggagatagactttgcggggatggatttgaggtgaaggcagagaaaaacgctgtggttggaaagagatagtggaactagttacatgagggcatgaagaaaaaggcggaacgcggtaacggcaacagggtgttgggataccatggagttgggctgacggaccgctttttctgtttgatgtgatgtgagtttagctgggatgaaatccggttgccatgtatggggcggcgtgataaaatagggttacccctcggagaaggagggcaaagttgattcaggagagttcttctcctgctggttcacggcgtttcgccagggaatccatttttgagagattaaagttttggaagcggggagtggtgcttttgactgtgatttagggagtctgaagagtttattgcacaagaaaaattggacatggacgcgggtattgggtatactgatgttgagagaaaacgggaacaggagggggtacgcaatggccgtgtacatgggagaggaagaggtaatacaaaagaatatggcactggcacaggaaaaggtgtacacagtggaggatattgaggcgctgcctgagggtgtgcgtgcggagttgattgacgggcagatgttctatatggcgacgccgtcgcggaagcatcaggggctggttggaaatttgtttggagaaatatttgctcatttgaaccagaacaaaggaaaatgcgcggtgtatccggctccgtttgccgtatatctgaatgaggacaaccggacctacctggaacctgacataaccgtagtctgcgaccgtgacaaactggacgacaacggctgccacggcgcaccggattttgtggcggagatattatcgcccagcagccggagccgggactgcctgctgaaactgatccgctaccgggaagctggggtacgcgaatactggatcgtggacccggagcgggagacggtgacggtgtatgactttgcggagaataaggtggggagttatacgtttcgggataaagtgagagtgaatttattcccgggtttggagattgactttgcggggatggatttgaattgaagaatgtctgaatacccggcaaatccggggcggggttccaagaatccccgccccttttccgcatttgcctttacatcccccgccgcaaaatgttatactaaccatacacacaatttaaactatattcggaaaaaaggaaaaacctatgaatctggtaaccattgaacatttgacgaaatcatatacggagcgtctgctctttgacgacacggcgttttccctgaacgaaggggagaaggtggggctgatcggcgtaaacggcaccggaaagtccacgctgctgaaaattgtggccgggctggtggagccggacggcggcaccgtggtgcgggggagaagcctgtatatccgctatctgcctcagatcccggagtttgtggagagcgacaccgtgctggagagcgtggagcgggaaaatgcctcggagccccatttcacctcccgggacgagctgctggccactgccaaaaatattctcaacaagctgggaatcacggaccacgaggccaggatcggcacgctgtccggcggccagagaaagcgcgtggccctggccagcgtgctccttagcaccgcggacctgctgatcctggacgagcccaccaaccacctggacagccagatggcggattggctggaggaatatctgaaaagcttccggggagcgctgcttatgatcacccatgaccggtattttctggacagcgtgaccaaccgcattgtggagctggacaagggcaagctctacagctatcagaccaactatgagggctatctccagctgaaagcggagcgtttggacatggcccaggccacggagcgcaagcgccagaccctgctgcgcacggagctggcctggatgcagcggggtgcaagggcccgttccaccaagcagaaggcccatatccagcgttttgaggccctgcgggaccagaaaggcccggaatttgaccgcaatgtccagctggaatccattgcctcccggctggggcggactacagtagagctgaacggcctgtgcaaggcttacggagacaaggtgctgattcaggatttcacgtacatttttctgaaaaatgaccgcatcggtatcgttggccccaacggcagcggaaagtccacgctgatgaagatgatcgcgggctgggtgcagccggatgcggggactgtggagatcgggcagacggtgaagctggggtatttctcccaggagagcgaggacatggacgggagctgccgggtgatcgactatatccgggatgtggcggagtatgtgaagaccaaggacgggagcatcagcgccagccagatgctggagcgtttcctgttcccctccagcatgcagtacactacggtggaccggctttccgggggggagaagcgcaggctttacctgctgcggattctcatggacgcccccaatgtgattttgctggacgagcccaccaatgacctggatatcgcgacgctcaccatcctggaagattatctggacaccttccctgggatcgtggttacggtgtcccatgaccggtatttcctggaccgggtggtgaatcggatatttgcctttgagggtaatggggcgatccggcggtacgagggcggatttacggattatcagattgctttggcccgcagggggctggaggaaggttcggacgcggcggaacgcagcggcggaacaaccggggccggtaaagcgggaggcgcggcaaagagcccggcaggtgcagcgggaagcgccgcggacggacagccttcagactccacccagcaggtgaacaagtccaactggaaacagcactccggcggcgagaagaagctgaagctctccttcaaggagcagcgggagtgggataccattgaggacgatatcgcggcgctggaggatcggattgccgggctggatcaggagatcgaggcttcggccagcaactataccagactcaatgagctgatggctgagaaagagaagacggagacaaaattggaggaaaccatggaccgctgggtgtatttaagcggccttgtggagcagatagaggcccagaagcagtgaccgcaggcctgggtccgcggatggaagatggaggccggaatgaagagcaggtttgagattgatcagagtgaaaaaggggagtacccgctgggggcgtgggcgacaaggaacgggatgcatttttcgtttgcccacccgggggagagctgcgtgttggtgctttaccgatccggcgggaaaactcccctggtgaaactgccgtttccccgggagcagcgcatgggggacgtgtggagcgcggcggtggccggggatttcgcgggggttgagtacctctatgaggtggacggcgagttgaagaccgacccctgcgggcggcagttttccgggcgggagcagtggggggatttgaaacgtccggcagcgcccctgcgggcaatggccttgccggagttggaagcgtttgactgggagggggaccggcccctggaaattccctatgaggattgtattttctatcacattcacgccaggggctttacccgccatgcctcctctggggtggagcccgctgtgcgcgggacctttcggggaattatggaaaagattccctatttacaggaactgggcgtgacgaccctggtgcttcagccgccggtggagtttgaggaggtggtgaggccggagtgtgtggaccggaacccttacgggattcaggaacaggcggacaagctgaactactgggggtatacccccggtcagatgatggctcccaaggcggcttacagcgccggggcaggaaaagcgcctgtgagggagtttaaagagctggtgaagggcctgcaccaggccggactggagttggtgatcgagctgttttttgacggaacggagtccccggcgtatgtgctggaagcggtccgcttctgggcacgggagtttcatgtggacgggatccgactggtaggctatgcgccgctgaagcttttgggcgcggacccctatctgaggagacgaaagcttctggctgccggatgggacggtgcggacggcggaaatgcaaggcatttggcggagtgcggcgaaggatttatgctggagatgcgcggtttcctgaagggagacgagggtaagctggacagcgctgctttctgcatccggcacaatccggcggacacggcggttgtcaactatatggcggacgtcaacggttttacgctgatggatatggtttcctacaacggcaagcacaacgaggccaacggcgagggcaatcaggacggcaccgattataaccagtcctggaactgcggggcggagggcgcaacccggaagaagaaggttctggccctgcgcagaaagcagctgcgaaacgcgcttctcatgctgtttttgagtcagggagcgccgatgcttctgtccggcgacgaattcgggcagacaaaaaagggaaacaacaactcctactgccaggacaatgagatttcctggctgaactggggacttttgaaacacaacggggatatctatgcgtttgcgaagtcggcaatcgcgttccgcaggagacatccggtctttcacatgagacaggaaccggcgctgatggactataagtcctgtgggatgccggacgtctcctaccacggtgtgaaggcctggtatccggatttcgacgcttccaggcgtcaactgggggtgctgtactgtggagaatacggggaacttccgggcggaggccacgacaattatttctacgtggcttacaatatgcactggacgccgcaggaattcgcgctccccagccttccgggcggtctgatgtggcatctggctgcggatacggatgatgcagagcaaaacgggtttatgcccgagggccgggagccgcttttggaggaccagcgcagcctgaccgtgcagcccagatccatcgcggtggtgatgggaaaaccgggggaggttaagaaagaaaagagagccggaaagaacatgagaactgagaaacagtaacaatcgtccgctggctgtgccagcggcccgttgcactcaaacagagacaggccgggattgaatcccggcctgttgcggctttgcaggccgcgggttacaggtgataggacttataaagccgggctctgacgtccggatcggacacggcctgctcgatgagatcgggccggttctcggccagaaggcggctgatcagggaggagagctgccgttccccacgctcaaatccctgtcggtctccgcgttcgaagccccgggattccccgtccgcaatcaggtcgtctatcgctttacacatgtcaaactcctcctctccttcggcttcttccatgatcttctgaaggcgcttctgctcgcccatcatggataacagcgccagctttgcggtgccgtccatatcccgcagctcggtccggttctcctgggcatagcggtacagggcggccttatctgacttatattttagcatactgaatatctgttgtaaatgggtccggaaaatggagggatcgtccatattggcggcgtttaccaggtttagacggtagtccggtatgtaaccggccagctccggcgcttcccctttgccgtccttaagacccaggagctcgtgcaggcttgtactgccgtcccaatgaccgcttccccagtagagcaccagggtgaccaccggctccagccggagttttgggccgactccggagagaaaaccgtcgccggaggggcgcctgcccgcctgtcggagctccttctcctggatttgaacctggtccgtgtaatccagcgcatcgtagagcagggagcggatcaccatagcgtagtgaatattggcctggttttccactgcgatcacggcgtatcgggtgccgcttttgagacgcattgctacatcgcgccggcgctccagcacctttttaatccctttgcggtccgcgtataacaccccctggcttcctttcacgggcatcaaatcttcaggcttcaggtacatttctccgcgaaataaaacgccgttgcacaggtcggaaaaatagaccgggtcggacagcagcttgttcaagtgtaggttttgttccgccataaatcgattacctccgatggggttcgggattttcagatgggttctgaatgcgtagagttgcgggaaggtccgcagggatcaaagaaagacagaaaatggactcggcaggtcgcttccgccgggccattatacggaatatgtttttttattgtatcacaaatttcagatttggcaagtggtaatcttcggattcgcatggtggacataatcttcggattcacatggtggacataggccgtatccgcgtaaattgctgatacggggcggttacaataaaaagaaatactttatattttgcttttatttgttaatgtggtaaaataatgattataaaaaaagacagatcgtgatacaaaggaggagcactatgctggatcgtcatgcattaaattacgtcaacggtatggaacaggaggcgctggaacttttaaaggagttggcgcagataccggcgccctcgggcaaagaggagcggcgggcggtattttgcagggactggctgacggcccacggagcggaaggcgttttcatcgatgacgccctgaatgtggtttacccggtgggggtggaggaaacgaatccggtggtggttttcgcggcccacacggacgtagtgtttcccgatgaggaaccgctgccgctgacggaggaggacggggtgatccggtgtccgggcgtgggcgacgataccgcctgcgtggtagcgctgctgacggcagcacggtacgtggcggagcagaagatccggcctcagggagcggggcttctgttcgtgtgcaattccggcgaagagggattgggcaatctgaaggggaccaggcagatctgcaaggattatgagggccgcatccaggcatttatcagctttgactgcaagctggatgagtttgttcaccgcgcagtggggtcccagcgctaccgtctgcgcgtgcgcacaaaaggcggtcattcctattacgcctttggggagaagaatgcgatcgccgagctggcggagatcatcggcaggctctatgggatcgaggtgccgcagggaggaaagaccacgttcaacgtgggaacgatctccggcggaacttcggtgaacacaatcgcccaggaagcggaagccctgtacgaattccgctcggactgccgggaagatttggaaatcatggaaaaggcgttttgcaaggtgatggaggaagcagcgcagagggaaggcgtgcaggtggaatacgaggtggtgggaatccgcccctgcgcgggcggcggagacccggagcgccagaagatgttggaacaccgtgcgttgtgggcggtataccggacgctgggatatttcccaaagccaagaaaggcatccacggattgtaacatccccatgtccctggggattcccagcgtgtgcgtcggctccttcatgggcggcggcgcgcatacccgccaggagtatctgcgcgcggactccttaaagagcggacttgggatcgccctggacctggcgctgggctactgccgggacgacgacggcgaggaggtctggtcgttacttcggacggaagatgaggggattttaaaagcggaagcgtagttggcgcggaggagcgggcgaaagcgtgactccccctgccgttattcggtcacctcgtagaacagctggtgctgtcgtttcacccgcgcccggatctggcgcaggaaggattccggtcccagcacccggaccacgggcccgaaggagagcacctcgatgagcagctccgtctcgtcggccatgtcgtagtagatggagcagatccaggctttttcctcctcgtcgtactccgtgtgtttttcatagttggcaaaatgcagcatgcagcgttccagggagttgcgctccccgctgatttttaaccgtaccggttccgcggccttacaggaattggaaaagcgcagcgcggcagcctccggcggcactgccccgctgcccggcacacagacctggatccgggccatgtttaagagaatggagcgggagaaacggccgtgggagcgccgcaggcagaccaggcggaacttgtcgtctttggaagaatattgcagttggcagggaaccgcctcaaaggaggacctgccgttttttgggccctgatagagaattttcagggtcctgttttgttccagggcttccagcaccgcctggaaattcttccggtaaagctccgaagtgtagtcgtccccgtccagatagcggtcaaaataatggaaatcctccggatcatagagggcttctgtgtccccaagggcttcctccacctccgccagctggctgtccgtgaaaaacagccgggctcgcggatcggccaggagggatttgagccaggatttctgcagcccggtgaggggcggtttcagccggtcgggatgatgcaaaacaggggcgtaggttttgtcctcccgctgctcaaacagcgcccagccgccgccggtgagcttgggaacgatggtgagcgcgctttcgcggtagctgtaggcgccgcagacatcgtccatatcccggcgcgtcagaggagcgcgggcgcccgcctccagcatgcgccgcaccacataatagtagcgcccgtatatcttatcaaacaattcagcagccatcagatttcctccccgttcacctcgccgtcccggcaatacatttcatacattttttcccagtcgtatgtaatcttagccactgcaaagtggttgcttccctggatgtccaaaatgcggccggtaaaggttttgacccaggagagcatctcgttggtatcaaaaaacgcaccgctgtagaggtattcattttcccggatccgctggatttccccgcccctgccctcccggtacagccggtccagcacataggcttccgtggattcatttacataaaatttgatacagatttcctccagacgtccgctgccggaaaaggagacgccccagagccggtccagattgcgcttcaggagatcctgcttccgactgtagtcggagtggatttccaggggcgtcacatcgctcatggagtccaggcgcatattggtaaaacgccgggtgttttcctggtacaggcacacatagcgcctgccggtgcgggtgctgacgaagattttgagaggcaggccccggctctgggaaacgttgccggttctgctgctgcggttggtgaaggagatggcgcgcccctgcttcatggctgccagcacatccgaaagcaccccgtcctccagcgtgtggacgatgaaatggtgtttgaactggaaatattcattgtccgtctcctcacggtcgagaatggtgctgccgatcacgccgaagggggcggtaccctgaaaaaatttcacagccattatcaaacggtcccaggcagaggagggaccggccgtttccggcgcgagcagaggggccagccggtaacggagctgctttttgtccttcccggccgacagcagacccagggactcgtattcctttagtttgagccgcactgtctggctgtcgaaaaccacgccgtagtccgcgcagatgcggtcgcagagctccccggccgtgagaccgccggggcttggggattcgggaagcgccgccccggcctgtgccgtatcggtctgtgccgcatcggcctgtggcgccctggtctgttccgccccggcctgtgccgccccggcgttctcgtttccgttttcgatcatctggtccagcaggaaaaaatgcagcatcagatcgttgtccgtgaagctcttggatttccaggccgtgtagaggggattctgggggatttccttgctgtccacgttgatgtacacgtgcttgcccttggacgtgtagtccgcccgggtgtaatccgccagccagctctcgatgcggcggcgctcattgtcgtaggtgcgggcgcttttgccgtcaaattccgtgcgcgccttaaaaccgtatatgtaaaactgccgcatatagtcgcgtatgcggtcgaaattcttaatcaattcctgaaattctgccataatcctctctctttatccggcggggaacgcctcaacgccttaagcgttgaggagcagatcgtcccggctgagcaacatctcaaaggtagcgtttttcgattggagcaggtgctcgtacatggcttcggccgcggctttccagtccttttttacgcatgccttgacgatggccaggtgttcgctgcgggtgtcctccagccgctgcaccgcccgctggccggtgatgatgcggatgcgctggttctggttgttgatgattttaaaattttcctggatgtagtgattgggcaccgcgttgtttaaaaagtcgtggaaattgtcgtcgatgacaaaaaagttcttggagtcccgggtcagatccatgcgcaggaatttctgatagtaatccatcagtacgttctcgtccagggtgtatccgtagttctgaatgctgtagggttcgagcagcaggcgcagttcgaagaggttgttcacctcgctgatggacaggctggatacaataatgccttttttaggccgtatggtaatcagcccctcctgctccagccggcttaatgcgtctcggatgggtgtccgacttacgttaaatgtttcacaaagtatctcctcgttgagcagcataccgggggagtattcacagctgatgattttctccttaatgttattgtatgcctgggacttcaagctttttttcgtcatattggataacgtctccttccaaaatattggatacatctttagttccattatagtaaaaaaattggtaaaagccaagggtggagcgagaaaaaagtatgtggcgccagattgaaaatggtgatgaatacaataaattacgtatttatcagggaaaacaaccatatgtctggatgaaattgaggaaaaacgtaaaaattagtaaaaagttataaaaataacaaagataaaatcacaaaacaggataatatttaaataactattgacaaggagctgcaaatattataaattatgatgtatacaacaggcggaacggccggttggaagtattgtgaaactgagaagaaggagctaatgccactatgaaagctgtgtttattgagaaccccggcaaggcggtgataaagaatatcccgcacccggccagaaagcccggagaagccctgttaaagctgctttacggggggatttgcggaagcgatctgggctcgtaccgggggacgtttgcatatttttcctatcccagaacaccgggacatgaattttccgcggagattgtggagatcgacgaaaacgaccgggggttaaaaccgggcatggttgttgtatgcaacccatattttaattgcggggagtgttactcctgcaaacacggccttgtgaacgcctgtatgagcaatcagaccatgggcgtgcagcgcgagggggcgttttcggaatacattaccatgccgctggaccgcatttacgatggaaaagggctggaacccatggtgctggctataatcgagccactctgcatcagctaccacggcgtaaagagggccggtgtgaagggcggggataaggtgctgattgtgggtgcgggaaccatcggcatcctggccgcggtggcggcgaagcagaagggggctgaagtatacatcgcggatgtgtctcaggtgaagctggattacgcaagggaattcggcgtggacggcgtggtgttggcagacgggccggaggcctatgagcgggcggtaaaggagatcacagggggaaatggattcgacgtgaccattgaggccgtggggcttccctccaccttccagaactgcatcgacgcggctgcgtttggcggacggatggtgctcatcggtgtgggcaaggaaaatctggattttaattttaccatgatccagaaaaaggagctgaacgtgttcggttcccgcaacgccttgaagccggatttcctggagctgatcgatctggtgaaggcggggaagatcccgttaaagaagattatcaccgacgtctacaagtttgaccaggcgcccagggcgtttcaggagctgagcgagaacgcgggccggatgttaaaggtgatcattgactttacgtgacggggaacgaaacggtacggatcaatcaggaggtacggtatgcaggaagttttcagaggattggagccggagcgggtattctggtggtttgaccggattgctcagattccgcacggctcggggcgggaacaggggctgagcgattccatatacgaatatttccggaaactgggattttccgtgacccaggaccagcactggaatttgattatccgcaagcccgcaacggcggggtatgagcaggcgccggccgtgatcctggaagcccatctggacatggtgtgtgagaaggaggcggacagcggacacgatttcgacagagatccgatccgcgtcctgcgggacggcgaccggctgtatgcggacggaaccaccctgggggcggacaacgccacgggcgtggcctttgcactcagcattctggagtcggagacggcggtccatcctgcgctggaggtggtgctgaccaccggcgaggaagccggtctgaccggggtgaagcggctggatttcagctccctaaaggggcgggtggtgatgaatctggattgcagcgacgagggcatcgtggtgggctgcgccggggcctcggtggtccggctggagcttgcaggcgagtttgaacgctcccgcagagagcagcaattctacggactgcgggtgtccgggcttttgggcggacactgcgggctgcatatcggcctgggccggggcaacgccaacgtgatcctcgggcgggtgctggcggcggcgtcccgcacaggcggtttctgcctggtccgggtggagggcggaacccagaacggggccatctgccgggaggcaaaggctgtgttcgcggtggaacagggggacatgacagcggtggaacaggctgtggcggaatgtgcccgggaactgaagcatgagctggcggatgttgacccgggattggagattgaactggaaaaaatccccaatcagaccgccgtattatcccaggaggacagcgcggcttacgtgagtctgatcaatctgctgccgtcgggcgtgctggagatggagcgggacgacgagggggaagcaaaagaaccgtccgctccgcaatccgtcctgcgtctcaccatgaaccatctcccggaaacctcctgcaacatcggtatggtttatatggaagggagccgcatctgcattcactgcaactgccgcagcagctacggcagcaagaagcgctggctgcaggagaagtgccgcctccttgccgcctgccacgggcggacggcgtattcggtgctgaccgattacccggagtgggagttcaacccggacagccgtctggcccggttgatctgccgggagtaccgggcgcagacgggggaacccttgctggtggagcgctcccacgggggcaacgagtgcggcacattcagcaaacggcttcccggtgcggatatcgtgtgcatggggacgaagatccatcacgcccattcgcccagggaatgggtgggcatcggtgtgattcagaaggaataccgtctgctgctgggcgcgctgcgggcgatgaaggattatgagagacaggaggataagagccaatgtacgagtgtttaaaagggctggagccagccagggtgtttgagctgttcggggagctgtgccggattccccacggctccaaaaatgagaaggcggtcagcgattacatctgccggttctgcgaggaccgggggctggaggtctggcaggacgaggcgtacaacctgatcattaaaaaggatgccaccccgggctatgaaaatgcccccacggtcattctccaggcccacctggatatggtgtgcgagaaaaatgccggaacggatcatgattttaccaaggatcccatcccggttctgagggacggagaccgcatctacgcggacggaaccaccctgggagcagacgacggcacgggcgtggccttcgccatggcggttctggaggcggacgacattccccacccccgcctggaggtggtgctgaccgcggacgaggaagcggggatgagcggaatcaaggccatcgatttctcgaagattacgggccgggtgatcattaacctggattgcagcgaccagggcatcgtggtgggctgtgccggttccgcggtaatccgcctggagctgccggtggagcgtgaggcggtcccgggcaactgggagtgcggggagttacagatccgcggcttaaagggaggtcacagcggcctggatatcacaaaggaacggggaaatgccaacgtgctgctggccagaatcctctcctctctggcggagacctgccaggtgcgggtgggcggctttcacggcggacttcagaccaacgccatctgccgggaggcggaggcgaagatcgcatttccggcggaacgccgggaggaggtggaagcctgcctagaggcgtgggagcgcatcctgaaaaaggaatttaagatcagcgacccggacgtgcgggtcgggctggcggaaccggccgagggctggggcgtgttgaagccggagagccaggagaagctgctggatgccatgctcaacatcgactgcggcgtgatcgccatgaacgcagaggttccgggagtccctgagaccagcggcaacatcggcgtagtgacaacggaaagcgggaaagtggtgatccgcaccctgtaccgcagctgctacgacagcaaaaagcagtacgtggtggaccggaaccgcaggctggcccgcttgctgggggcggaattttccgtggaatccagctcgccggagtgggagtacaaggcggacagccgcttaagcgccctgattcagagaatctatgagaaacggtttggcaaaaagctggcggtggaggtgtctcacgggggcaacgagtgcggcgcgttcttcaaggcgtttccggacgcggacatcgtctgcacgggaacccagatcataggagcccacacgccggatgagagcgtgctggtcagcatcgtgcagaaggagtgggagatgctctgtctgaccctgaaggggatgctggagtattaaatgggaggccggcggctgggcagcgttgcagccaccggcagtacaacagtttaaagcggcgaaaggccgttttgataaaaagaagaaaaaacggaggaaaaaacatgaaaaaagcattatcactggtattagctgcggcaatgacactgtctctggcagcctgcggctcctcaggcggcagcacacaggcgcctgcgaccacaccggcccagacggaagccggttccaaggctgagggcggagagagccaggcggcaaccgaggcgcctgcggccaactttaagatcggcatcctgacctccacggtctcccaggccgaggaggagtaccgcgcggccgaggctgtaaaggaaaagtacggcgatatgattatccaccagaccttcccggacaaggcggccagcgagcaggagaccaccatctccatcgccctgtccctggcggctgacccggacgttaaggccattatctgcaacaccgccatggaaggcaccgctgcggccatggagaaggtgcgtgagaagcgcccggacatcctgctgttggccggcgttcccagcgagtccccggacgtgatctgcgcggctgctgaccttgtgttccatcccgacgttgccaatatgggcaccgcggttgcggaagctgccgctgagatgggcgcaaccacggtggtgcattactccttcccccgccatatggcgcagcccttaaacattgcccgtcacgacaacatgaaggcaaaatgtgaggagctgggactgaagttcgtggacggaacctcccccgaccccatgagcgacgccggaatcgcagctacccagcagtatatcctggaggacgtgccgcgtaaggtggaagagtacggagccgacaccgcgttcttcggaaccaatgcgggacagcaggagcccatgtgtaaggccgtgtttgaggccggagctatttaccccatgcccgacaatcccagcgtgttctacgccttccccggcgccctgggaatcgaagtgccggaggatcacaagggcgacgtggactacatgagagatcagatcagcgccaagctggctgaaaacaacatgacgggccgtatgggcgcctggagcgctcccatgcacaccatgttcatcaactgcgcggttcagtacgccatagattactgcaacggcacctttaccgagcgcgcggacatggagcatttcacgcagattttctctgactttgcaggcggcgacgtgagcgtgcgggtgtacgaggacatcgagagcggaaagacctatgacaacttcttcgtggtgctgggcaagttcatcactctgtaataaaacggcaacagagtaaaaccaggagattgccttccgtccgggaggcagtcgtttgtaatcgttctgacggcttatcttcttgaccgaaaaaggccggtcaagaagcatcggatgtccatccgatgtgaaaattggcacggaaatccgcttacaagccaacttgacgcggtttcccgcaccaattttcccgccgtctgaacggttacgttaatttacgaattggaaaagaaagagggttttatatggccaagcaggcgctcctccattttaaaaatgtaaagaaaagcttctcgggaaatgtagtgctgtccggtgtggattttgagatcttcccgggacaaatcgtggcgctggcaggtgaaaacggggccggcaagtccacgctgatgaatattttatttggaatgaacgtgatacaggagaccggcggttacgagggggagatcatttttgaggggaaacccgcgaaaatccagtccccggaggacgccatggcactggggatcggcatggtacaccaggaattcatgctgctgccgggctttacggtggcgcgcaacatcaagctgaaccgtgagaacgtcagacccaacctggtgagccgggtggcgggaaaacggttcgagcttctggacaatccccgcattgtggaggaggcggccggagcccttcacaaacttggaatggaaatcaatccggaagtgacggttgacaagcttccggtgggacatatgcaatttgtggagatcgccagggagatcgacaagagcaatttaaagcttctggttctggacgagcccaccgccgtgctgacggagagcgaggcggagcggttcctcaaatgtatccgccaggtggcggacgagggcatcgcggtcatttttatcagccaccggctggacgaggtgatgaccctggcggactccgtggtgattctgcgggacggacagatggtatttgacgagaaaacgaagaataccagcaagaaccagatcgcggagctgatggtgggccgcaagctggaggcggacagcatgatcaatgtgaaccgcagctttgacggcagcgacatcattctggacattgagcacctgagcgtgagtatgcccggggagcggacgaaggatgtgtccttgaaggtgcgcagaggagagattctgggcatcggcggcctggcgggtcacggcaagaccagcatttccaacggcattttcggcatgtacccggccaggggaaaggtgcgctacaacgggcaggagctggcatttacccgggtgggcgaagccttaaacaagggcatggctttcgtgtccgaggaccgcaagggcgtgggcctgctgctggacgagtccatcgccctcaatatggtctacacggatatgaaggtgaaccggcggttcctgaaaacgtatggatttttcagcctgttcgacagtaagagcgcggagaggactgtggaggagatgatcggggagctggatatccgctgcaccggctccaagcagctggtggggcggctctcaggcggcaaccagcagaaggtctgcatggcccgggcgctgatcaccaagccggatctgctgttcgtgtccgagcccaccaggggaatcgacatcggggccaagcagattctgctgaattacctggtgaagatcaacaaggagctggggatcaccattgtgatgacctccagcgagttaaatgagctgcgcaccatctgcgaccggatcgccatcatcggctccggcgtggtccagggaatactgaaacccgacgccccgaatgtggactttgcgctgctgatgtcgggagaaaaaggaggagacccatcatgaccgctgttaagaattcactgaaatcctttggatttccgcgcctgatcatcatggcgttcctgcttcttctgattatgatgatgtttatgctgggaattccggcgccgctgacattttcccagtgcatcgtccgggtaggcatcaatatgattctgtccctggctatggtgccaggcatcatggcgggcacgggcatgaacttcgcgctgcccctggggatcgagtgcgggcttttggccggaatgatcagcctgcagtacaacatgacgggcgtgggcggcattttcatcgcaatggctatttccgtgccgttcagcgtggcggcgggctgggcctacagccagctggtgaaccgggtgaagggcagcgagatgatggtgtccacctacattgggttttcggtggtggcgctgatgtgcatcggctggttgattcttccttttaaccatccctccatcgtatggcccatcggcgacgggctgcggaccaccatcaccctggaagcctggtatgaccgggcgctgaacaatctgttcgcctttaacgtgttcggggtggagattcccgtggggctgattctggtgatcgggctgttctgtttcctcatctggctgtttatgagaagccacctggggctgatgatgaaggcggcgggctctaatcccaatttcgcccgcagcaacggcgtgaaggtggacaatatgcgcaccatggcgaccattctctccaccgtgctcgggggtatcggcatcatcatttacgcccagggcttcggcttttaccagctctacaacgcgcctctgatgatggcgtttccggccattgcggcggtgctgatcggcggggcgactcccagccgcatctccatcttcaacgtggtgttgggaaccattatgtttcagagtatgctgaccattgcaaccccggtggccaacagcctgatccctgagggcaacctgtccgaggtggtgcgcaccatcgtcagcaacggcattattttatatgccttatcccgtatgcaaggagggaaacgataatggggaatgagaaaaaacacaaagcgggggtctttctggaaaaactcctgatcaacaacgccgtgaccatcctgttctgcatcatctgcgttgcgggcattattttggcaaaacagcccttatcctttattgtgggggagatttccacgcgtctgttccgcaatctgatcctgattctggctctgctggtgccggtgtgggcgggcatgggcttaaacttcagcatcgtgctgggggcgatgtcggcgcagatcgggatcattgtggccaccaatttctcggtatccgggttcgcctgcctgatggtgtcctttatcgtgagcatcccgctgtccctgttgttcggcaatctgaccggacgtctgttcaaccagaccaaggggcaggagatgatcaccggtatgattctgggattttttgccaaaggaatttatgacctggtgtttatgtttttatgcggtccggtgattccgattaaaaaccagacgctgcttctgaccaacgggatcggtctgacgacgcccattaacctggaggcggataccaagggggctatcaataagatgtggtccatgtcgctggatcaggcgatcggatgggttttgattgcactgctggcggtgcaggcggctgtgctggtttataggatcagcgtgaggcatgagaaaatacgctgggcggggcagtacaagctgtatttgaccgcggcgcttctggcggcgtttaaggttctgtgcgctgcgtcgaagacggtgctgtttgcacttcagtttacggatgtgccggtggtgaccgggattctgattttctgcgtgtgcatctatatcacgtttttgagcaggaccaagcttggaagcgatatcaatgcggtgggtcagaatatgaatattgcggtgtccatgggaataccggcggacaagatccgcatcacggcgattatgatttccacgctgctggccggcttggggcagttgatatttattcaggatatcggcaatttcacgacctatacggcacatgagaacgtgggcacgtttgccattgcggcgttgctggtgggcggggcttctattaagaaggcgaccatcggacaggcggtgctgggggcgctgctgttccacaccatgtttattatctcgcctatcgcgggtaagaatctgtttgataatgcacagctgggagagtatttcagggtgttcgcgtgttatgcggtaatcgcggtggcactggccttgcacgcctggaaaacggttatggccaagcgggtggatgatagcgagagcgaggctttggaagcgcaggaggcgcagaaggcggcatgaatgaacggtttaaggagcggctggtccggctgatgagggagaaacaggtggacgcgatgatgattgcgccgtctgaggagctgcggtttttggcgggatttaacgtgtaccaggacgagcggtttcaggcgctgtttctgaccgcaaaaggcggggcgttttatatctgtaatattttgagccgggacgaggtggcggaggggctgggggaacccatacccgtccacacctggacggacagtgaggatttcgcggcagtggccggggatgtgttggaggagtacgggcttttagggggaacggtgggggtgaactccaccgttcgggcttttaatctgattccggtggcggagcggacgggaatccggtttgtgaacgggaaggagtggctggaggaaatccgcatcattaagacgccggaagagatggagaatctgcggattgcggcaaggatcgcggacgatattttcccggagctgctggagtttatcaggccggggctgcgggagatcgatattcgggcagagatggagcggttgtttgcggcgcgtggggtgaagctggcgggggatattgtggcatcagggccgaattcggcgctgccgcattattttgggaaccagcgggtgattgaagagcaggatgtgattgtgctggattacgggtgcagttatgaagggatgttttctgatgtgacgcggactgtgtttgtgggaggggttacggaggaacagaggaaggtgtatgagattgtgcgcagggctaaccgggcggcaagggaggcggtgcgtgagggggcgtttattccggatgtggacgcggcggcaagggatttgatcgcggcggaggggtatggggagttttttacaacgcggctggggcatgggattgggtatataacgcatgagcaaccggagattaaggggacgaaccggaggagattggagcgggggatggcgtttagtgttgagccggggatttatatggcggggaagtttggggtgaggattgaggatgtggtggtgatgggggaaaagggagctgagagattgaatcggacggggcatgagatggtggtaatttgatgagacgcgggaaattttgatgcatccgttcgtgagagccagaaaagcggggccggagactcctggtctccgcggctaggatagactaaggcgccgggggccagaaaagacgggcactgctccgagctccggcgcaggcctgatgcctgcccctccgcctccgctttctccgggcgttgtacgccctgcgaaatcccgccttttccggcccccgccgcctaagtctatccaaaccgctccaaatgtcgcctccagccccgcttttctggctctcacccgctggggggtggagagggccggtggggattgggggaggcctacttgcgtttacagtttttggaaagaattgagtctctgcttccgggagtttcctgggagtggggacttttttgagttcgcaactttttttagatgattttaccagtttgattcgttatgatgtaggcataacagatttgagagagagaaaggaagtgaatggcatgtttgtcatgtttgagaaggaagagtttaaggttccggtaagggtttggctggagggcccgggggtgttggaggagagttgtctggaacaggcgcgccatttggcaaagcttccttttttgcataagtgggtttgcttgatgccggatacccatgccgggatggggatgcccatcggcggggtgattgcggcggaggatgtggtgattccgaatgcggttggcgtggatatcggctgcgggatggcttatacggagacgaatattccggtaaaggagattcggcaggtgatgaccgggaacgggaatctggtgcaggctatgatcggcgatattatgcggaatgtgccggtggggttcgcacatcacaagatgatgatgccgtcttataccatggactgcgcctttgaggagatggaacggtatgagcaggacgccgagcttttgggacagctggaggcgggttattatcagatcgggacgctgggcggcggaaatcattttattgagctgcaagagagcgatgatggttttttgacggtaatgattcattcggggtcccggcattttggaaagtcggtttgcgattatttccattttaaggcaagggagctgaataaacggtggtacagccaggtaccggatgagtaccggctggcgtttctgcccacggatagcagcgaggggaaacggtatctggactggatgaatttgtccatggattttgccaaggagaaccgggaaaagatgatgttggcggtgaaggcgatacttgagaaatggatcgggaagtatacggattttgaactgacgttttccggggatatcaactgtcaccacaattatgcggcgctggagaaccactatgataagaatgtgtgggtgcaccggaagggggcggtacgggcgaggaacggcgaattggccgtgatccccggggccatgggctcctacagctatgtggtgatggggaaggggaacccggagagcttttgttcttcttcccatggggcgggcagacggtattcccgtaagggcgccatgtccgcgttcagctgtgaacaggtgattcaggatttgaatacgcagggcgtggttcttgggaaaaagaataagagcgacgtggcggaggagagccggttcgcctacaaggatattgagacggtgatgaatgatcagacggatttggtggtgccggtgaaacggttgaagaccatcggtgtggttaagggttaggcggccggaaggctgcggtttgaggtgatataaaggaaactttatataaatggcggctgaggcgaaggttttggctgccgcgggcgggctgctcttgaggcgtagggttttccggttggcggagcccttgcggtgccgcaggcgtttgccgggcggtataccggcggtccgggccaggataatgatttgtcgtgggttcgaatcccatcatgtttgaggacatgtagctaagtggtatagcaatcatctaacaaaacgctggcattgcgtaaatgccgacaaccagggaaatggaactgccttcgccccggcttggaaccggcagccgcagagcgtttgctctgcggggacccggggagagcagtccgcgggacggccagcgccggtacggataccggctgccgaatcgaggtggaatgggtggggaaattgtgaggataggagtgccgggcgggaaatcgtccgcggcctggatggagcttgcgggtgggaaactgcctggggccctggacgggctcgccggtcaatgaaaccgccggaactgccctctcaattacccctcctccaccgggacacggagcctgaagtgccggcccccggcctgcggatggggcggggcagggatattttccaacatatggatagaaacggttgtgaattgtaaacagaaaatggatcgcagcggcaaggcgcgggacggtgggaaacgccgggcgcgccggtgggatgggaatctgccgttgcggggttttaggaataaagaggaaatggaaatgaagtatttaatcaaggagcaggagtgcggatatttgatgaagaacggccggtttgtgcggttgctgatggccggtaagtatcggtttatgaaggagctggggtatgaggtccaggtagtgcccatgacagggcaggtcaagacttgtggaatcccggaggagattctgatgggagaccgggagtttgctgcgcgggtggtgaaggcagaggtgccggatacctgcctggcgatccggtttgtgaatcaggcattcaaggaggtgctgaccgggccggaggcgctgttctggaacgtgtttgagaaaaataccttccagatggtggatatgacggagccctgtatggagaaggttctgccgcggatgtacatcgatctgatgcccatgaaatattataagaagattgtggtgaaggacggcgaggtgggacttctgtattttgacaaccgcctggagcggcgtctggagacgggcagctattatttctggaactatggccgagaggtgaccggcaagatctttaatatgaagatccagcagttggatatcaccggccaggagatcctgaccgccgataaggtgggggtgcggctgaatgtggtgtgcagctaccgcatcacggacccggagcggctggtgaagatggtggacggggcctcgggccagctctacacctgcgcccagctggtgctcagggagtatgtgggccggttccggctggatgagctgctggcgcagaaggaggagatcggccagtacgtgctgcaaaagctgcgggagcgccaggaggagttctgcgtggaggtgacgggcgcgggtatcaaggatattattctgcctggcgagattcgggagatcatgaacacggtgctggtggctgagaagaaggcccaggccaacgtgatcatgcgccgggaggaggtggcgtccaccaggagcctgttgaataccgcacggctgatggatgagaaccgcaccctgttcaagctgaaggagatggagtatctggagaggatttgcgataaggtgggcggcattaccttaaacggaggaaccaacgtcctggagcagctgtcggagctgatggcgtctaaggggtgaggtaggaggcgggagtgccgggaacaaagcttgcactgcggccaacccgggtccccgtccctccctctgtcataatgaatccccaccccacataaactagagtgggtactcggaacactggtccgctggcgccgccagcggaccggtgcatccaaacgagtgcccccggccatacggtgagtatgtccgggggcatttttgcgccgggagaagccggaaatcaggcggacggcggcgtttggcagagtatttggccccgcgggcagaggccggagtcagggaaatgtgacctggactcatcgtttccgcgagaataagagaaaaggggagaccgacatggcggattggttcaggctgtcaaaacaggaaacaatgtcgcagcttacaaccggcggacagggattaggcagccgcgaggcgaaggagcggctgaagcaatatggggaaaatgtgattgaggaagccgggcgcaaacagtggtggcaggtgtttctggaacagtttaaggatctgctggtcatcatcctgatcgtggccgcgggaatctccatggtgacgggggatccgggcagcgcgggcgtgatctttgccgtgctgctgctgaacgcggtgctgggaaccgtgcagcaccagaaggcggaaaagtccctggacagcttaaaatccctgtcctcccccgaggcccgggtgcggcgggacggaaggcagctcgacataccttcctcccaggtggtgccgggggatattctgcttctggaggccggtgatctggtggccgcggatgcccgtctgatcgaggtgtacggtctacaggtcaacgagagttccctgaccggggagtcactgaacgtggataaacaggacacggttttggggaaaacgcgccggaacggacgtggggctgtggataagagcggtccggcggacgacgtgccgctggcggaccgggtgaacatggtattttccggctccctggtcacgggcgggcgcggcgtggcggtggtcacggccacagggatggacacggagatcggcaaaattgcttccatgatgaacggcaccgaggagcacaagacccccttgcagatcagcctggaccggttcagcggacggttggcggccgcgattatcgccatctccgcagtggtattcgccctgagcctttaccggaaggcccaggtattggacgccctgatgttcgcggtggctctggcggtggccgccatcccggaggctctcagctccatcgtcaccattgttcaggctatgggcactcagaaaatggcccgggagcacgccattatcaaggatttaaaggcggtggagagcctgggctgcgtgtccgtgatctgctccgataagacgggaaccctgacccagaaccgcatggaggtggaatacgcctgtttgaatcaccgggagcgggatatggattggatgcgggaaaatgccttccgccccgacgtgcgcctgctgctttacggcgcggtgctaaacaacgacgcctcggcggaccccgaaggccagacggcgagggatgtgggggaacccatggagctggcgctgttacatatggcggctcaggcggggatgacgccggaactggtgcgcgcccgctgccccaggctgggggagctgccctttgacccgcgccgcaagctgatgtccaccaaaaaccaggtggaggacggccagatcattttcgtgaagggcgcgctggatgtgctgctggaccgctgcgaccgcatcgccaacccggggagcgccaaatccgccgtcagacccggttccggcggggagagcgccgctctggcttcccgcacgctgaccgcccaggaccggcggcggatcgcggaccagaatatgaattggtcgtcccagggcctgcgggtcctggcctttgcctgcaagcccgcagaggagattccgggggagaaggcgcgggcggaggaaaatttgattttcttaggcatggtagcgatgatggacccaccccgcagcgagtcccgggccgcggtgcagaatgcccgccgggccggaatccgcaccgtgatgatcaccggggaccacaaggtgacggccatggccattgcccggcgtatcgggattatggacgaaaagacccaggcgctcaccggagcggagttaaacgccatagacgacggggagctgtcccgccgcctggattccatttccgtgtacgcacgggtttccccggagcataaaattcgcatcgtggatgcctggcagaagcgcggctccattgtggccatgaccggagacggggtcaacgacgctccggccttaaaaaaggcggacatcggcgtggccatgggcatcaccggcaccgaggtgtccaaggacgcggcctccatgatactagcagacgacaatttcgccaccatcatcaaagcggtggccaacggacgcaacgtgtaccgcaacatcaagaacgccatccagttcctgttgtccggaaatatggccggaatcctctgtgtgctctacacctccctcagtgccctgcccatgccctttgcgccggtgcacctgctgtttatcaacctgctgacggactccctgcctgccatcgccatcggcatggagccgccggaggaagggctgttaaaggaaccgcccagaaatcccagggagggcattctgacgcgcacctttgtgcgggatattctgctgcagggcggcctcatcgcccttgccaccatgtggtcctaccgcacggggctctccaccggcggcgcggcccaggccagcaccatggcgttctccaccctgacccttgcccggctgttccacggcttcaactgccgcagccgccattcgatcctgcacctgggctttggcagcaatctgtacagcctgatggcctttgagctgggcgtggtcctgctggccgccgtgctgtttgtgccgggtctgcaggtcatgtttgcggccgccgacctgggactttaccagcttctgaccatcggctttgccgcatttgccccaacgctggtgatccagtcctttaaaatgttccgcgaaagcgtggaataaagggtaaaaccaaagtaacagatgagttttccgtttgccgttttatactccggcggggccgcggttccgccgggaaaaaaccgggtgttcacaccgaagcgcatttcgcgattcgtctccagaccgatctgtctgataaattcaaccgttcccactacaatacttctcacacaagcgaaagctgtattgtttcaagaaagaggaccaaaaacatagaaaaattcggaaaaatgtgatagagtagaaaatacaaaaaatcattattggaagtggcggcaggccggaagcggacgaagccggacaaaaagcaggaggacatcatgagactggtaacatatgaaattgaacgtaaggtgaagctgggcgtggtgagccaggatgagaagtggatctatccgttgcagtccctcggtatggattacaccaccatgcaggaggtgatcgagcatatcagcgattcggaactgcagcttttagagcacgcctccggtctggagaatagccggatcgaaggggccgcgccctggagcgaggtgaagattctggcccctattcccaatccggttcaggacgtgatctgcctggggatcaactacatggctcacgcggaggaatcggcccgcttcaagaaggaagccttcggcggcgagcgcccttacgcgatctatttttccaagcgggtggaccgggcggtggccacgggggaagggattcccagccatcgggacatcgtcgccgacctggattatgaggcggagctggcggtcattatccgcaaggaggcgaaaaatgtggcgccggaacaggtgaaggactacctgttcggttacaccatcatcaatgatgtcagcgccagaacccttcagacacgacacaaacagtggtatttcggaaagagcctggacggatttttacccatgggcccctgcatcgccacagtgaacagccttccctatccgcccaaggtacaggtacagtccagagtgaacggtgagctgcgccaggacagcaacacggacctgctcattttcggcatcgaccacattgtcagcgagctttcccagggtatgaccttaaagccgggcacggtgattgccaccggcacgcccgcaggggtgggaatgggctttgaaccgcccagattcttaaagcccggggacgtggtggagtgcagcatcgaggggatcggccgcatcgccaacacggtgacagagtagactacctgcagacagaaaggatggacctatggactatttaacgatgacgattggaaaacagaaaaatatagcgctgattgcccatgaccagaagaaacgggagctgatcgactggtgtcaggagcacagggaggtgctggcaaagcattttctctgcggcacagggacgacggccagaatgatcacggacagcaccgggcttccggtgaagggctacaacagcggccctctgggcggagaccagcagatcggcgccaagattgtggagggcaagatcgatttcgtgatctttttctccgatccgctgaccgcgcagccccacgacccggatgtgaaggcgctgctgcgcatcgcgcaggtttacgacattcccatcgccaacaacaaggccagcgcggatttcatgatcacctcctcctacatggaccaggagtacgagcatgatatcattaattttcagcagaatataaaggacagggcggacaccctttgagggcaggacgcattttgatggatcgcgagaataaaaaaagaaaagggggctccaattatggaacaaactttatatgatttgatggattgggctgggattgaggaattggtatattcggaaggaagcaatccccacgggcttttgggtccccatttgacggattcgggtctgctggtgcaggcgctgattcccaccgcacaggccatcacggtgaagatcaccagcacgggccgcaagtacccgatggagctggcagacgaggccggattttatgcggcgctgatcccgcgcaagagtatggcggcctatacgctgattgtgacctatgacaacggcgccaccgaggagattcatgatccgtactcctatgcgccgcagtacacggacgaggacgtaaagaaatttaacgcgggcctccactatggaatttatgagaaaatgggcgcgcaccccatgaccgtcaagggcgtggagggcgtttatttctcagtctgggcgccatgcgccatgcgggtcagcgtggtgggcgattttaacctctgggacggacgccgccatcccatgcgtctcctgggggactccggcattttcgagctgtttattcccggtctgaagccggggcagatttacaagtatgagatcaagaccaaggcgggactccccatgctgaaggccgatccgtacgccaattacgcggagctgcgccccgacacggcctccatagtctgggatatcggcaggtatcagtggcaggaccgggagtggatggagaaacgggcgaaggacgagctgtttaccggaccggtttccatttacgaggttcatctgggctcctggaaacgcaaggagctggaactggacgcagagggcaaggagatcaccggctcggagttttacaattaccgggaaatcgcaggtccgctggcggattacgtgaaggagatgggttacacccatgtggagctgatgccggtgatggagcatcctctggacgcctcctgggggtatcaggtgacggggtattacgcgcccaccagccgttacggcactcccgacgacttcatgtatttcatggactacatgcaccggcagggcatcggcgtgattctggactgggtaccggcacatttcccgcgcgatgcccacggcatggcttgttttgacgggacctgcgtgtatgagcacaaggacccgcgccagggcgcgcatccccactggggcacgctgatttacaattacggcaggccgggcgtttccaatttcctgatcgccaacgccctgttctgggcggacaagtatcacgccgacggcatccgcatggatgcggtggcctccatgctgtatctggactacggcaagaacgacggtgagtgggtgccgaacatctacggcggcaatgaaaacctggaggccgtggagttcctgaagcatttaagctctgttttcaagggccgcaaggacggcgcggtgctgatcgccgaggaatccaccgcatggcccatggtcacgggggagccgaagaagggcggactgggctttgacttcaagtggaacatgggttggatgaacgacttcaccaactacatgcgctgcgaccctctgttccgcaaaaataattacggtgagttgacgttctccatgctgtacgcttacagcgagaactttattctggtattctcccacgacgaggtggtgcacggcaagggatccatgatcggaaagatgccgggcgcggacctggaacagaaggcggagaatctgcgggccgcttacgggtttatgatgggccatcccggcaaaaagctgctgttcatgggccaggatttcgctcaggtgagggagtggaacgagaacgcctcactggactgggagctgcttgagacggaacctcacaggcaaatgcaggattatatgaaggcgctcaacgagatttaccgcaaatatccggctatgtacgccatggattacgacccggagggcttccagtggatcaactgcagttaccagcaggagagtatgatcatctttgtgcgcaagacgaagaagccggaggaaagtctgctgttcgtctgcaatttcgacaatatggcccatgagaaattccgcgtgggcgtgccctttgagggtaaatacaaggaaatcctgagcagcagcgccgcagagttcggcggaagcggcgctcccaatccgcgggtgaaaacgtccaggaagctggagtgggacgacctggaggattccattgagatcaatgtggctcccatgagcgtcagcatcttcacctgcacgcctgaggccgcgcccaagaaagcgcgcaaggcagagaccggcaaggcgaaaaaggccggaaccagggcggaagcgggaacggctgcgggtaaggacggaaaagcggctgccaaggcggaaggggagaagaaacccggggcggccgggaaggcggcaaagtccgcgccaaaggctgcaaaagccggtaaaaccgcagcgtccaaagcagcgcaggagcctgcggcaggggcggctaaggccgaagcgcctgcgacggcggcggagaaacagaagaaagcagcggcgtccagtgcgaaagcaggggaaccggctgcggccaaggcggagactgcaaaagtagaaggaaagctgcctgccgccgcgggtggtcaggagaagccggctgttgagaaagagaaaaaacctgccgccgcaaaagaggggcagaagcggttgacgactgcgaaggaagagcagaagaagctgacaaccgcgaaggaagagcagaaaaagctctccaccgcgaaggaggagcagaaaaagctatctaccgcgaaggaggagccgaaaaagctttccaccgcgaaggaagagcagaaaaagctatctaccgcgaaggaagagcagaaaaagctttccaccgcgaaggaggaacagaaaaagctctccaccgcgaaggaggagccgaaaaaactctccaccgccaaacgtgcccagaagaagctggccacggtgaaggaggagttgaagaagctgaccgcccccaaggaggagaacgataaggatgctcaggactgagtagcggaacggcaccgcaacccggcggttttacggccgtttgattgacttttatcccatctgctgttaaaataattaacaaagagctggcctctcatcatactggtgaggggccgttttacaccgggaacggacgcagggcggcgggctgtttccggttttaaggcggggtaggggtatgctggaatacattaagaatctatggtttacaatctctctgaagaaaaagctcggggccttcgccgccatggtcattctggtcatgggggtgtcggttgccttcaatctccgcatcatgaatttttccctggacagtttcaacgtaatactgcaggacaattcccgctgccatgatttccaggaagccctggagcttgaggtcagcgccttcgagtcctatgttcggagccggacgcaggaacggcgcgacgagtacgtgctggcctgcgtgcgaaccaaacgctgcctgctctccctgccctttggctacagccagattggccaggagcggtacgccaggacctggaacctgcgcaacgggtatgaaagctacagcgcggcccgggatctgcttctggaaatggacccggaggaggacggctttgtgcctgagctctaccggatctatgccatgcagtcttaccttcagacctatgccaggcggctggtgcaggccacgctgaagtacggaaacgccagctatcaggaaaaggtatccgtattctacgacatgccgtatctgattatgatcttttcgattgtcatgatgattgttgtcatggggctgacccggctgctggccgcggcgctggtctcgcccatgatgaaaatggcccacaatgcccgcaagatcgccagaaatgatttcagcgggcaggacctgaccgtgccaaaccgggatgagatgggagagctggtgaaggcgttcaacaagatgaagcatgccacggagggctatatcaacaccctgaaagagaacaatgagatggcggagctgctgcacaaggaggagctggaaaagatcgagatggagaagcgcctggacgcggccaggctggagctgctaaaaagtcagatcaacccgcattttctgttcaacaccctgaatatgatcgcctgcatggccaagctggaggaggcggccaccacggagcgtatgattgccagcatgagcaatttgttccgttacaacctaaagacctcggagcagatcgttccgttggagcgggagctgaaggtggttcaggattatatgtatttacagcagatgcggtttggcagccggatcggctacgagtgcgtgacaaaggtggacccgaacggagtgatggttccggcgttcaccctgcagccggtggtggaaaacgctatcatccacgggctctccaaaaaggagcagggcgggaaaatcgtgatccgcatctggagaaagggcggcagcgtgatcatttccgtggcggataccggagtcggcatgccgcagcagcgctgccgggagctgtcggaggccatgcagggcagcaggacctcggggatcggcattggacttggaaatatttaccagagaattaacaccatgtataagggcggcggtttgagactgtacagcagggagggcagcgggacggtggtgcagatgaccattccgcaggacggagagatgaatcccgcgcagcagtgacagaggtgaggagggagagagtatgtatcgtttgttgattgcggacgacgagatgatcgaacgggcggttctttacaagacgctccacaaaaatctgggggaccagtgcgccattttccaggcggaaaacgggcgtgaggcactgcgcatctacgaggaggagaagatccagattgcgattctggacattgagatgccggggattaacggcatcgaggcggcgcagcggatccgggaaacggacaaggactgctgcatcattttcctgaccgcctttgacgaattttcctatgccaaaaaggcgattatgatccgcgcattggattatctgttaaaaccctacgacgagcaggaactgatgctggtgatggaggaggccatgcgccttacggatgcgcatctggcggacgcggcggccttaagtggtcgggggcaggcggcgccggggatgggagccggggagacggccgccgcccaggagccgcgggaggagctggaggaggacggaaatatccgcctgtccaaggtggcggagctgatcagccagtacatccgcgagaattatatgtacgatatctccatgcaggagctggcccgcactatgaattactccgagccgtatttctgcaagctgttcaaacagtgctttaataagaacttcacctcctacctgacggagtaccgggtggaggaggcaaagaagatgctggagcagcccacggtaaacgtgaaggagatcggcaaggcggtgggttacggggactccaactatttcgccaaagtattcaagcggattacagggcagagccccacggaataccggttgtacatttttcagaggggataaagattgtataaagataaatctgtgccttgtgcataaataaaatgctaaaataggttaaaatcctactatgattcacaaaaaattaccatgttcagaatgtgtttttcctcttataattaatataacgtaagaaaaacgttatgatttagaaaagatcatataaaaaatgtattaagaggaggacatgtgacatgaaaaaaagatggcttagcacagcgctgtgcgcagttatggtagcatccgccctgaccggttgcggcggcggcgcaaaagagaccacggcggcggcaaccgaagctgctactgaggcgaagaccgaggcggcaaccgaagctgctactgaagctgctaccgaggcaggttccgaggcggctgcggacacggcgaaggagccggttggaccggaagttaccctggtgatggcggaagtaaacccgctggaaaccattgttggccagaccgattccaagtttaaagagagagtagaggagctgtccggcggctccatcaagatcgacctgcaggccagcggcgttctgggttctgagaacgacgttctggataccatgctgggaggcggcggaaccattgagatctcccgtatttccgcatttgctctgaccagctacggcggcgagaagtccaaactgttatctgtaccctataccttcgcaggccgcgagcatttctggaactttgtaaacagcgacttagctccccagttcctgcttgagccccacgagaacggcacaggcgtgagaggacttttctacggcgaggaaggtttccgtcatttcttcaccgtgaaagagatcaccggcttagacgacttaaagggcatgaagctgcgtgtgtccaacgacccgatcatgaacggcatggtggaaggcttaggagccagccccacggttgtatccttcaacgagctgtactccgcactgcagaccggcgttgtggacggcgctgagcagcccatcgcaaactacaagtccaatgcattccaggaggttgcccccaacctgatcctcgacggtcatactctgggcgcaatccaggttattatcacggatgaggcatgggataagctgacccccgagcagcaggatatcctgatgcaggccggcaaagaggcttccgagttcaaccgccagatttccgaggaagctgagaataaggtgcttgaagagctgaaggcagatggaatcaatgtgatcgaggtcgacgacatcactccctggcaggaagcttgtaaggacatcatcaacgagtccacgaaggataacgccgagctgtaccagcagatccttgatatgaagtaaattgccactatttaagggcacaggggagcaatgcctctgtgcctgattttttgaaagggggatcaatatgccggctatttttgaaaagattgacaggattaaaccgttttacgatctgacttacaaagtcgtgctgtttgtatgcaaggtgcttttggtcattgatattgcgattacaagtatggcggttgcgggccgttacataccgtttataccggacccggcctggagcgaggaggtcgttttgacctgcatgtcgtacatggcggtgctctccgcggctctggccatccgccggggcgcccatatccgcatgaccgctctggacggttacatgccaaaatgggcggtaaaggccctggacattttcgccgacgtggcggttttgattttggcttttattatgatcaccgtgggctggagatacgccaccgggatcggctccaagggaacctacgtcagcatgcccaaggtttccagattctggatgtacttccctgtgcccctggcgggcgtggctatgatcatttttgagatcgaggccctgtacaaccatgttaagggaatttttgtaaaggaggataatcgataatggatgcaaacacaatggcaatcgttgtccttttgggcagtttcttcctgatggtgctcctgcgtttcccgatcgcctacgcggtggccctctcttccgtgctctgccttctggctcagggcaaaaacttaaactcggtctgccagctgatggttaagggaatcagctccttcagcctgatggcggtccccttcttcatcaccatgggctgtcttatgggttccggaggtatttccgaaaagctgatcgcgctggccaacgcctgtgtgggctggatgcgcggcggcatggccatggtgaatatcgtggcttcctacttcttcggcggaatctccggctccgcttccgcggacaccgcttccctgggttccattctgattcccatgatggtggatcagggttacgacgacgatttctccaccgcggtcaccatcacttcctcctgtgagggactgctggtgccgcccagccacaacatggttatttacgccaccacggcgggcagtatctccgtgggaagcttgtttttagccggatatctgcccggcgctctgctggcgctgagcctgatgatcggctcctatatcatttccgtaaagcgcaattaccccaagggcgacaagttcagcctgatcaacctgtttaagcagttgggtatctccttctgggccctggctgcggttctgatcgtggtgtttggcgtagtgggcggcgtgttcaccgccaccgagtccgctgcaatcgcggttatctacagcctgatcgtcagcgtgttcatttacaggggactggactggaagggcgtttggagggtcctgggcgactgtgtggatacgctctccatcgtgctgatcctgatcgccacctccaacattttcggcaactgcctgacccagctgcatgtgccggatatggcggctaaggctatgaccggtctgacggacaaccggattctgctggcgctgatgctgaatctgatcctgctggttctgggctgtatcatggatatggctcccatcattctgatcgccacgccgatcctgctgcccattgcgacctccatcggcatcgatcccatccagttcggcatcatggttgttttaaactgcggtatcggacttctgaccccgccggtgggagcggtgctgttcatcggttccgctgtgtcaaaggtgcccatggaacgggtggtaaaggccacgctaccattttacctgtgtatgattatcaccctgctgctgattacctttgtcccggcggtcagcctgtggctgccttctgtgttgggcggcatggcgaaataaaggctgcggggcttgcataatccgtaaaattacgctatgattttataatcaggcattaacgtgagttaatgcctgattatataagaaacggttttacgccggcccgtggagggcggcgaaggccgaaactgtgattggcgaaaggggaaccggttatgaaataccagtacacttaccggaacacggctgccgaactgtggcagctgtccatgtattacacctatggttccttggtgggactctgcaacattattttcaccgtggcgatcatcgtcatgggcgtttccagatggccggagctgagcaatctcatgcgggggcttgttctgctgtgcggccttctgtttacggtgatccagcccatcgcggtgtaccgcaaggcgcagaagcaggcggctgggatcacggcggacacccgggtgggattcgacgacgcggggcttcatgtgatgacggaggacaaggacgctgttttggcgtggagcaaggtgaagaaaatttccaaaaagcccaccatgattgtcatcttttcggacaccacccatggatttgtgctgagcaaccgggtgctgggatcggaccgggcggcattttacagctacattgcctcaaaggtaaagagataacggctggaccccggcgggtccggctttatgtttcttgccggagccgccgggcccgggtgggattgcagggattccggtttgaggggaggtctgatgaatttggaggaacaagggatggatcaggggacattgaggcagagggcggactgctggggctgggagcaggagaaggggggagaagcgcggtgaaaacgaaaatggcggtgtttctcctgtgcggcgcagcgcttttgaccgcgtgtgcaggggccgggggaggaaaggcggattccggggttccggaatttgtgctcacctacgccgagaaccaggcggaggactatcccaccacccagggggcttacaagttcgcagagctggtgaaccagcggaccaacgggaagatcgaaatccaggtcaacgccgggggcacgctgggggacgagcgctcggtgatcgagcagcttcagttcggcggcgtggacttcgcccgggtgtccctgtcgccccttgcggagttcgtgcccaagctgaacgtgctgcagatgccttacctctataccggcccggagcacatgtggcgcgtcctggaggggaaaatcggcgacgactttatgaattccttcggggattccaacctcattccgctgtcctggtacgacgcgggggcccggaatttttataattcagtgcgccccatcgagacgttggaggacattcgggggatgaatatccgggttcaggagtcggaactgatggtggacaccatcaaggcgctgggggccaacccggttcccatggcttacggggatgtctactccggcctgcagaccgggaaaatcgacggggctgagaacaactggccctcctacgagtccaccaggcactacgaggtggccggatactataccattgacgagcacaccagggtgccggagttgcagctggtggcccagtccacctgggataagctgtccccggaataccagaacatcatccgggaatgcgcgcaggaatccgcggtctacgagcggaagctgtggcaggagcgggaaaagatctcagagcagaagatccgggaagcgggttgcgtgatcacggagctgtccgcggaggagaaagcgcggttccaggatgcggtttcccctatgtatgaactgtactgcgcggattatgtggacattatcgaccagattgtggcagctggaaaatagaggccagattcaatcaaaccagagcgaaaaaacgcccggcggattccatggtgttggaatcgccgggcgcttttgcatttgcgtttggtgaattaaagtacagggacgatgatctcatcgccgccgcctgtgggttcggccggggagtcggaggccgccgtggtgggagcggatgcgggatcctgaaccggggccagggtgccgggctggggaccgccgttttccggtgaggaggtctccggggccttcgtcgtctccggggcttttgtggtttccggagcctttgtggtttccttggcttttgtggtttccttggctttggtggtctccttggcctttgtggtttccttggctttggtggtctccttggcctttgtggtttctttggctttggtggtctccttggctttggtggtttccttagcctttgtagtctccttggtggcggagctgctgttggagtcctccgaggacttggcggcgctatcacccgaagcttccgcggacccggaggagctgttctccattccctccacccgtctgctatagacaggggagatctggttgcccgcgtagtcctgaatgtatacggtcaggctgtcggtggtcatgggcagggtaacgattccgctttccgcgtcggcggagaggggctttatattctgcttgttggcgtccactccgtagattcccgcgtagtccaccccggactggctgtcgtccaccacgatggtgagcacgtcgttttcaatggtatagttctcgtccaccgttgggaaggaatcgtccaggggagagatggcctcatagatgggagccgcgctcatgccgttccagccggtcgcctggatctccagcacgccgttgctggtgagcgttgcggtgtatgtatttttattgcgttccagctccacctcgttggactccagcgtgaccttcagggacttgacgggcagcagggacttgaccttgatggagatgtccagggacttgtaatccttggtgtcgcctacggtcagttccactctgggcgtggaggtggccaggaagaaaatgaacaggttgagcacaaccaatgggaggacgatgcagaccattgtgaacaggacacggttgtccttccagcttcgtttgggataagagttgcgctttttattgcggccgccgcgcggagagtaggagctgccgccagatagggaacgctcgctgcgcggtgcgctgtatgatgaatggtgattcataaaaacctcctgtggtaatcgtaaaaatactcctatagcatatcagaaaatgtttcttcttacaagtaattaaattgcccgtccgtcccagaaactgctggaaataacgcaaattcgttgacctttcagatattgtaagaaaatctaaagtaatcctgcggtgattcttaatgtaattgtgatagaatgtaactgttcctcagccagggccgttgccgcacggggggcgccgcagtttttcacggcaagcgccaaagtttaagatgggactactaaatgccaccggtttgtggtagaatggaagagaaccccaaaaggacatgccaaggcaaaaggagctattgttatgattgaagaggcggccgcatttgcggagcgggtacacaggggaacttttcggaagggaaccacaatcccctacattgtacatcccatggagacggcggtgatcgtatccggctttaccgacgaggaggagatgatcgcggcggcgctgctccatgatgtggtggaggatgcgggcgtgacgggcgaggagctggaggcgcggtttggatgccgcgtgaaggagctggttctggcggagagcgaggacaagagcaagtcctgggaacagcgcaaggcatttacgctgagccatctggcggattccagccgggatgtgaagattctggccctgggggacaagctgagcaatatgcgcagcacggcgcgcgactacatggtgatcggagacgccgtgtgggagcgttttaacgttaaggagaaaaaaatgcatgcctggtattactgtggcatcgcagacgcattggaagaactgagcacacatttttattacgatgaatatgtgctgctttgccggaaggtctttggaacgcactgagactggatggaaaatattggaattagaaggagaacgtgggaatggttttatcaaatcggaaacgaaagctgttggcggttctgctgacggccgggctgatgtgctccctgccgggcatgagcgccctggcgggttccaccggagtgggagcggccaagacggccgcggagcagggcggaccgggggttgtaaaggagcagccggagcaggctccgtctcaggatcaggcgggcggcaaagaggcggctcagacgccggaacagcctggggacggcggtcaggcccaggccggagacgcaggacaggctcagaccgacggtggcgcacaggctcaaacgccggaacaacctccggcgggagattcggggcagccgcttcagatcaactacagcgtttttttccatccccagggatggacggatacaaagccggacaatacgccgcttcaggcccccggcggcagctgggtgacggctttgaaggcgaacctgatcaatatccccgcaggggcgcaggtgggcgtgcgttatcaggtgaatttaagcggttccggctggctcgactgggctgaggacggagcggagaccggcggcgcaggcggtgagatgcccctggaagccgtgcgcttcggcctttacggagattccgcctccggctatgatatttattaccgggttctgcaaaacgggtcctggaccgactgggcggcgaacgaggcaacagccggacaggaaggcgcggggcttcgcgtggatggaattcgcgtgggcatcgtggctaaaggagcagagcctcccgccgacgcggcagcgcctgcctccgggatcgatccctccaggccgatgatcgcgctgacctttgacgacggccctagaacctcggtgaccagccggattctggacagccttcaggccaacggcggccgggcgacgttctttatggtcggctcccgggtagactccaacgccgacgtgatcaggcggatggcggcccagggctgtgaggtggcaaaccacacctacgaccataagtatattaccaagattggggcggatgggattcgcagccaggtgggttccaccaaccagaagatccaggcggtctgcggcgtggctccgacgctcctgcgcccgccgggcggctataaggatgccgcgtctttggcggtgcttggttccatggggatgcctgcggtgatgtggtccatcgatacacgggactggcagcacaagaattcgcagaagaccatcgagacggtactgagccaggtgaaggacggagatatcattctgatgcacgatatctacgatcccaccgcggatgccgcggtaaccctgatccccgagctgacggccaggggatatcagctggtgacggtgagcgagctggcctcctaccggggcggaatgcagccgggccacagctacagccagttcaggccatagaaagctgtgttaatgtaaatgagagtgtgagggcgtaaagcgatggctgcgccctcactttttattgaatgcaatggaccgttggcgtagcctgcgggcgattgttgagtgcaatggccgctgcgattgagggtatcggctatggtttttttgtggtatactgaaatttaagaaggcccggaaaagcggcggacggctgttttatcatatcccgcggcggcggggatgggccgttacaatttttcttatgtttgacgcgtttttcgtccatactctatagtagcacgaaaatggatcaggatacggcggatttgcgcgaggaggcgggaagatgaaattttggctgaaatgtctggcggccgtggccgtggctgcgatgctgctggccctgtatgactctgtgttcaacggccttttgaacaaggacggctacaagccggttacggagcagatgcgggacgttatggatcaataaaatataaattttaattttgcccttgattatttgtcaagggtcctatataatatgttctacagaaacacagttctgtgttctgtctgcgcgtttgcgcagctccatgtatcggttctggatcatggatttcccgattttttggattaaattggaaaagtgtaccttgaaaatggaatgctgtccggcggcggtggaattgccacagtcttttttgcgtaccgcaaatttttatagcacagattgacaattcgattgtttgatggatacgatgattcaccggcagggccggtgggtgatggttgttgaatggaatgggccgttggcgcagccggcgggcgattgctttgtgtacccaaaaatcaggaaaagggtgcggaacaggaggttatatggagtggaaacggggatgttcgctggtgttggccgtggtgcttgtgttaaatgccgtgcagtggccggcgatgaagggatgggcggctgagccgggccgggaagccgggaccgtgacagaagtgcacgctgcccgcgccacccaatcggaggcggagcaggcggcgggggagaatgaagcggaacgggagcgtccgggcgggggagagatgtccggggaagagagacccggaggtgggactgtcggaggagagacggccggaggagagaaacctggaggagagacgactggaggcgggacagctgggggagaaatacccggaaatgggacgcccggcgaggcggaattgtatgcgccggatatggaagcagaaggaatcagccggttttttgtccggaatccccgggcaaataacggagggaagctggaggtggacggggagcaggtttggtatctgaattacatcaaggactcgcctgacaagagctacgcttatgaggttctggatcaatccggtgaaacggtggaccagacatggtggaattattggtgggatgaggagctgggaggctggcgcatccaggcgaagccgacccagtattctctggaccatgaggaataccggtactttattctggatgaggagggcgtgttggccacggaagttcccgcaatgattgaccggaagcccgtggtatccatggacggctgtttctctgcctgggctatgccgctgcgaagtcccggaaccattccagacacggtggtgagcgcaaaccactgctatgagaactcggagatcaccgctatgccggaactgccggaagggctgcggagcatggaatatatgtttgccggctgttcggagctggaggaaactgtccgaatcccccagtcggtggaaaacatcgattatggattttgcggttcgggaatccgggaaacgccggagtttgccccggggagccgtattcggaagctgcggtttacattcagggactgcatttggctggagcggctgggatcgctgccggagcaggcgcaggatctggagggaacgttctggggcgcgctgacagcgggcgcggacctgggggaagcagagctgccggattccgtgacggagatggaggacacgtttttcgactccaatctggcggtttcacccaggctgccggagacggtgaaaaacattgaccgctgttttatgaggtgtaccggtctggtccaggttccacttctgccggacagcatcgagtcggccaaccaggcctttgaccactgtacgggcctgcgctttggggacggggagaatgtctgtgtggcggctccgaagtcgctggccaacgcggaccggatgtttgccagtgcgtatcgcaccgcgggcagcccggatacttacgggagagacagcgagctgttgtacctgtgggatgagggccagtgggagaccatttaccaaaacgcgtttgaccaggagccgggggaggagtcgcgggacgcgtacggcgactacaacctgttcagggaacccatcgggttaagcgccatggagcttgtgacaacgggaccctatatcgacagcgagctggttcttgagggcggaaagcgtgcgcaggccgtcaccttccgggggattttggggcgctacaaagctccgccggactattatcccgaggatgtgatccaatatcggatcgggggagccggggagtttcaggactgggatggaaatccggtgtatctgtatgaggacgccctggtggaggcaaggaaagtccgcagtattcgaacttataacggggcggaaaccgttgtcacggatgtgcgggagaaaatggtgcgggtgcagcagccggatgtgccggttttggactggaactatatgggaggcggtgagtatgacgtcaccattatgtataggccgtggctgcgcagccttgagcgcgtggagctgaactaccaaatcgacggcggaccgtggaaatccattggaaatttcgggcatctgcgcgcgcactgcggtcagacggtgagcgccgttgcagactggggcgcggtgtcggacgcagcgcttctgcgtctgccggattatgtaaagcgcattgaggtggagaatccggcaatttatacgggaattcatgaatgcattcccattgtctgccggctgtctgaggcggacgccggggataaaacctaccgggtggaaatcaccggcgatccgggcgggattgcccaggtgtggcgggatgagagtgggaattggagcataggcaacagcggctacggccaggttacggtccgcgtgaccgccaatgacggaggtagagctgcggcggaacacacattttcctttgtaagcccggtgcagtcggtttccgtggcgctggaaacacacccggacggaattctgagaaccggtgaaaccgaccgggcgctggtttctattattccgtcggatcggacgggatatcagctatccgtatcggatgccacggttctgcggctggatgcccgggaagggactgtcaccggactgaggcgggggactgcggtgttggaggcccggtcttctgtggatccttcggcggcggggcagataaccgtccaggtgcaaagtgatccgggctggattgagctggagccggaggacgctgaactgtacagcggggagaagctccgggtgtcctgcaactgggggccgcctgggacggcggacccggagatcgcgcaggagggacttccggtggactggcgcaccgaggaacagggagagaattttatccgcggcgaggccacactccgggaggagggggcgtgggggaccacaaaactaacgtttcgcgccaaatccaaccatgaggtactcggactgtgcacaatcacctggaaaccctatatccgctccatcaaattgaccgggccggagcagatggcggcaggaagccgggcaaagacccaggtggtgaaggatgtggagtcggatgaaacgctgcgctacagctcgtcggccccagatattctggaagtctctccggctggggagctgacggcgaaaagggccggggaggcggtgatcactgtgacggccggttacgggggagcgtccggcagcatttccgtgcaggtgtcggagccggaggagaaggatattttcaatatcaggctgacactggaccgggatgtgttgagggagggggaggtatgcggatatcaggttctggtggagccggagtacacctccggtatctggtccgttacgtcgtctgatccgaaggtgctggagatactggacggcgggaaaataaaggccgtggctccgggaacggcaagtgtgacggtccgggaaaccgccgatccggcaggcaaggcgccggctgaggatgaacgaaacgtcacggtgattcccaaccagacggcggttctggaggtatatccgtccgatccgctctgggagcggaacggggagccggtgatttacaagaatcttccggggggaagagcgattggctttacctgccggatcctcaccgacgctgacgaccaatcggtgcgctggagcgtggaccgggaggatttggcggaaattgacgagaacggtgttttaaggcccgcgggcaacggtgtggtgacggtgacggcagccagctgcgcttatccccaggctacggccggataccgggtggagatccgcacggtggcgactgatatccgctaccgggcggtggaacgggactgggggaaatatgtgctgacagcgtcggtatggccggaggatgccagtccggaccggatctattgccgggatcagagcgccggggaagcgtttgaggacatcacgggccgggagtacacgctggagcggattgaggatctgttggaattttccacctgtacgggccaaccggccatagaggatgtaagcaggcggacgttaatcgatgtgtcccaggagatagatcggcggtatgaactgcacagctttcacacggaggagctttatacggtatatacgtccgatctggacgatcaaaacggctttgttctgcgcatttacgacagggagcaggggcgatatctggagagcggggagcacagcggggtattctggcctgcaacctttgaacggtgcggggattttggggaggaaaaaccgctgccgattctggtgtccggtgaaacggacgggcttgtgcatttgcgggtgcagtcaggggaccagctgaacagtcagtccggtgcgttcaccgacatccattttctgagctccgggccccactgggagttggagggcggcgaactttccagaaaggagtaccggatctgttcggactggccgctgcctgagaatgtgaacctgcgttgtctggatcgggctggttatgaacgctatcggtatgatctgagcctgtatgacggcgggatacccgagtttcattgcggcggaagggatcaggtctgctatacggcggccaacagccagcagggggaggtgtatctggacattaacggggagacatttccatccctggaagcctgtgaaaaacggtacgatatactgatttactgcggcgaggaaaatgtaaccagccgcatgctgaagcgggtggacagccagggcaggccgcaggttctgctgatggatcagggcgttttcacaattaccgtatccggcgtgaaaacgggcgctgccgcagtccggcaggtgacggcagagaatgcgggagatttctataatctgtttttggaatgcccggccacggaatttcagcatgtggatcaaatctgcagccttcagcagttccggggcagccggagcatttacacctatatggcgccgttttcacgggagagcgatccggtgaacgcgagctatggggtgcggtacggaaatgccgtccggttggacgatgtccccggttatgagttgacgtatgaactggcggccgacccggatggggggatgcgggcggagtattccggccatgcggtcactgccaggggatatacctcggacactcaagctgagccgccggagaatatcagggtcacggtgaagcgggagggggagactgtggcggttctgtacggaaggtatcaggtacagtggcagctgcctgcggtggaactgccgaaggaacagtacctggcagtggggcgggagtgtagaatcccattgtattaccagagccaatacaggaatgagcgcggggccgtggtgcgcagggacattgaagaggggacggtgaggctgactctggacggccggcccgtgaccgggaccggcgaatgcggggattttgtgattacctgtcttcaggacggcgagcttgggctgatttaccaacgcgaacaggccggggaagcggagctgagggtttatgtggacggcgagcagatttatcagaacaccggggacccctcctaccgcggcgaacagctggcggaagccgcgtgcaggctgcatgtgttgggaaaggcccgcggggaggtggagaatatggtgatggacgtgggggaaaccgcctctgtggtgattcgttgcggtctgggggacgaggcttccgagggcgaaatcatcgcgtacaaggtgctgaatgctcccgcgggcagcgagccggtgcggatgaatcatacccggattatggctttggaagccggggaatggctggtgcaggccacagtccgtttttataaccgggcgtattatgatgtggtttgccagtttcgggtgacggcccgcaatcccgccaaagtgctgactgtcgcagagcggaacggccgcacaggctgttcggtgggagagatgctttatctggtaccggggtacagcccggcagacgccggaaatgtcctgggttacgcctgggaactggaaggagacccgcagggggcgcaggtcgaccagaatgggattgtgacggctgaggcggccggagattacacggttgtgctccgggatctgccggagcggagtttgagcgcggagtattcgtttcatgtggaagaggcacaggtgaaggcggaggccattgcggtgagtcccgccagcgcggaggcgggaggcggagaggatgtgcagtttacggcgcgtatactgccggaagaagctggagagcgggaagtggtgtgggaggttgaaacggccggccgcgcgtgtaatatcagccgctctggcgtttttgtagggctgaggacgggggattataccgtgcgctgctctctggcggaggacccggctgtctgtgcgacggctgcggttcatgtggaggtgcggcccgagcgccttgagatttcgggaccatcctgcgcagatgcagacagtcccgccaaactccaggccgttgtttttccgcacgatgcggtatatcagggaattagctgggagctgatcgcaggcggggatctggcggagatatcagatgaagggctggtgacgtgcggggagggaattggaaaggcgcgggtgcgcgcggcaatcgatgggacggatatcagcgcagagcgcgagatcgcgcttggcagggaattgccggagttgagagcagagattcgtggtacggacggcgcagtcaagggggagatacagggcagtggggatcaggcttatctgtatgtgaatggaaatcgggccaccggctcttacctggaacaaaaccactgtgatctgcgggtcaagccggatacgggcgggctggggattgacggcacgggctgtgtccatggtattttgccgggggattactccgtggaggtgagccgggaggcggaaggatttaccgtccgtgacacggtatgggttacggtgacgaacgagaatgattaccaatttttggagatttggccggaagataatgtgtacctgatcacagaaccaaccgggggagtaaggatgcagtaccggttgttgccgcagctgcgggagaaagacgagatcgtgtggtcggtggaatccggccggaacattgcagcgatagacggccacggcctcctgactgcaaaggggacggcggacggtgcggtgacggtaaagtgcgctgttttggaccgggaatccggccgggagcacatttcccagaactgcacgatcctggcgaccggccagatgattggagtgtcggaaatacggatcagctgcgccggggaagccctggaaggggagcgcattccggtgggggtgaccgtgttgccggaaaatgccggcaacagggcgtaccgtattctgatgtccgaccctgagctcggggagtttcgggatgggtggttttacgcctgcagacccgggaacgtcaccctgacggctatttccgaggataacccggcgtgtgaggatacggcggaagtgaccgtaaaaaggaaggaagacacagcgccggacggggaaggcggaagtggagaacttggcggaaatggcggcagcgaggcagaccgcagcgatacaatttcatatggaggacatggcggggcttcacgtggaagcgggacggaagtattcacattctggcggctgagggacggaaaatggtactactacagggcagatggaaccatggccgcggacagctgggttttgtaccgggatcaatggtaccggctgggggcagacggtgtgatgttaaataacagatggttctccgaaagcgggaaacagtattacctgagcgacaatggggccatgatccggggctgctggggccatgtggacggccagtggcactattttgaccaaaatggctggagcctttcggatgttgaggcgcgggatggcttccggctgagcggccaggatctggtttatatggggccggacaccggcagttggatcaacgtggggatttatacctattgtctggatgagcgcaggcgggtgatgaccggctgttgggtagaccgggacggagaacggtattatgccggtgccggcggctggattttgcggaatcagtggaacgaagtgaatggaaactggtatttcctggacggagaaggccggatggtgcgggaatccatcgtctgggaggggaaacgttaccagttggatgaaaatggaattgctagagataccggaagataagagcggaacggggcttatgcctggcgctgggccccaccggtattccggccccgcggggatggccccggaaggggatgtaccttggaaattgaataagaaacgccatagtttgacgggggattattaaataaattgtaagggagaagattatgtagtataatgtggttattcatgtcggaatgtggccgggcagcgcgaagaccggccaaagaaaagaggaactatgagaacgtatcgaaaagcggtgatggccattgccgcagccggcgctctggcagcgctggctgcggtaccgtcctatgcgggacagtggcagcaggacgggaacggctggtggtggcagaatgacgacggcagctatccatactggatgtgggcctggatcgacggcaaccacgatgggattgcggaaaactattattttgatgagaatgggtacctctccacagataccgccagccagggattgcaggtaaatgaaagcggggctctgctggtaaatggagttgtttgtactgcgcagattcccggcggtggcgactggtacccgggcgtcgcagtcgatgggaaaatgtttgtggcagaagccgaccgctcggaggtcaatgccgtggaggccgcgctggcggcggagcgggaggcccgggagagagcggcgaatgaacgcgaggacatcgatccctccgagctggctctgcggattgtggagctggtcaacgaggaacgggttcgaaaaggaaagacagagctggaaatcaatgacgaattgatggagagcgcacgggtgagggccgaggaggtgagcgagaatttctcgcatacgcggccggatgggacgagttatacgactgcgattaccttggaatatgctgctgcggctgagaatgcagcccatgtatatggatatacaatggaggagatagcgcatgatgcgttggatgcttggataaaatctccggggcatcatgtagcgatgatacaatctaaatggagtgacacgggagtcggggtatatgtaaacggtactcaagtaagtgttgcgcagttatttattaaaaacaaataaaagtatagagagaaaagggctattggcgaatctgtgtagatacgccaatagtccttttaatttgttgaaaggggggaacgtatgtattttttacggcagtttaagcggccaatttcatttttattagtagttatattgtcggctacattatgttatataccaacatatgcagaaaccaatatggttgaaatctggccacgtctaattatttttgcaaataaaaattttacagtgtttggaaaaacacaccatatgatgagttactatcaggagggactaagtccggatgcacaaccaacgttttgcctggaaccggggaaaaagctgccggatgggtctaaggcaacatataagatatataccgctacaggagatgaaacgattccgggagttggtgcttctgacaagtttgttccaataacccttgcttatgagtggatccagcatatcgccaatcttagggatcctgtttgctatgcagttgttcagacatatatttggggatgtgtggatggctatgcagaggattgggagattcaggaggaggcgcagaaaaaactagctgatattttgaataatagcagggttctaagcgaatttgccagcttaaaggaatttgtgcaagatgggattgaagaatttagtaatttatcctggggaggatttccggaatggaatggaacacaacagaccatgtttttggaagatgggaaatatacattaactttagatataacagcatgctcgcagttgaaaaatgttatctggaactttcctgatgctaattggaattatcaggttatagaaaacaaaattgcttttcaatataatggccctgattatccggaaggtgaggtaaggtcatccgatttatacggtattgggaataagtattatgcttatattttcacgccaggaaataatgggcaatatcaataccaggttgggcgctttgcaaatgaagaggttccagcacaggcattttttagggtctcaggatctattaaatcccatggttccgtcaccttcaccccctaccgccacaccgaacgcttcgattcccattacaacatttcccttgaaaaatactgtgcggagacgaatcagccgatggaggggtctgtattcgacatttgggaggattttgaccggtcgcagttgagcggtcgtaattatagggagggaaacccggacggacggaccggctgtctttatgacaatgcgtttgagccgtttcctttgggcgctcacatttgtgacacgatcaccaccggaccggatgggcggggggatcaccgggataccagatcataccgttacagcaagacatactgtaccgggcatcctgcgccggaatgggtggatgtgccggaggaggagtacgatgaggagacaggggaatgcacaaacgagggggagattgaggcggcagaggcggagaatgagcgtctgcatgacctgtggacagctcaacaggagctgtgcagcgaaacctgtgattttcatgtgggaaacgcggatgaggacaatcatgactatgactattccgcccaggaggagatgctggaggaccgggatgagacttatgaagaattcataaatttagaatatttatacacattgaaggaaaagactgcccggaccgggtacattctccacgggcgccacaccgatgatcaggagatggagaccgtgtcggtttcttccgctgagagcgggggaagcgccaggcgggcagaaatgagtggaatgctgcaatccggtgcggagccggaagaaaccgagaatcagcctgcgatcaatgaggagttaaagcgcctggtattttccgttgcagcgcctggactgagtctggaggatctgcgcagggtggaggacgtcgccccgcagatcgtgacggcgagcggaagcaatgctgcacggaataatagcgtggcggcgaatcattctaaatcaagcgtttctcccgcaagcgaaagcgatgcggactacttcatattaatcgatgagggagatggggatgatgatcatgagtttgaggaggagatgatccccgggagctatcgctatacctggaaaactgcggaaatacctcgaatgagaaaggcatcagcctcagaaccggtccgggacgaaccggaaactccggtggaatctctgatcccggagagctggggaccggcgtttttccgcctggcgattggacgcctgaccggggagcgggggatggatatatccgatggatttccagattttacggacgacgatctgggcgggatggagacagggggctatggggaaccgtctaccccactgtatgtgtttaaggtgtgggatcaccggacggaaggggagcttcacatcaataagcgggatctggagctgtaccgggcagacccggaacacagttttggcaaaacccagggggatgccaccctggagggtgctgtgtacgggctgtttgcagcccaggatttggtgcatccggatgggaaatccgggattatctacaatcggaatgacctggtggccgtggcgtccacggatcaagatggagacgcttccttcctggcgtttacggagaatccgggaacgcgccttgatccggacggaaatatccttgtgccggaaggtccgacgggggtcgggaatctctataacgggggtacaatcacctcgtcaagctgcggcttcggcgtcatttcctacccggattatgcggcggaaaacggagggcagtggatcgggcggcccctgctcatggggcgctactatgtgagggaattgagccgttccgagggctatgagttgtcggtacaggggattctggcgtcggagacaaaccgggaggcggacgggactgctgttgtggccgaggcagggacggcccggatcagcgcgggactttcggattacaacgatatgaacgcggatggctcctggaacgactttattgtcgagtcgtacaggacggaaaacggatacgatgtggtggttgccggttacccggaagggaccaggtttttccgcatggaggtggagcaggttacggaaacggttcagaccatcacaggcagcacgctggagccaaagaaggacgggaacggcaatgtggtataccagaccgcgaaaggtggagagtataagacggacggggatgggaatccgattgtgaaagatttgtcggatcattcaaaacctcaggcggagacggtgccttaccgcttccggatgagcggttatccccggggagaggcggaaccggaggatatcacgcggtggcaggagccggtgggggatttcgactacctgagggatgaggtcaacaaaatgtttcaggaggccggttacagggccttgtccgatgaggacggctctccctggttcaatctgaaattggcgggagacaccaacgcggaagcggggacggagattttagactggtttacagagcacaatacatgggacagcgcttcggtccactcggtttatgaggatgaggagggcgatctgtacgcgcgtatctattacgattactcaaaagcggatgagtcgtacccggctttttacgatgccgtgaaccagaaattatgcatccgcaaagaaatgacagtggagggcagagaaggaaacggacattattgggtgcagtatgaaaagggggagtataccctgggcggcgccacggcaacggccgggcaaaggcgggagataccggagggcacggcggtaccgtttggagatgagatcgaggtctggattgaggcggtctaccagccttcctatgagacatacgcgccaggggagacattgatggggcctgacggacagcctgttccggtgatggagcggacctatacctacggggaggccaaacagacggttgagcgtgagagcagtcgggagattgcggcctcccgcgaggtttctaccggctattacaccattcatgtggaaaatgagacagattgggatggaataagcgcgccggaatataccaggtttcgggcggtgacacggcagacggacatggaatatgagggagagccgatgccttacaaccgttatctggtggatgtagcaggcgccggagtgtcggccaatgcctccgtgcctgcattcgatgcggggagttatattgtgatggggacgctggtttatccggggcagcttgtggtataccaggatggcgggacccgtgacaagcctcttcaggtgctggagcgggtgattaaacagccgatccggataacaaaggacatttcccaggcttcttacgataacgtgaacacctacggctccttgcacaatgatcccatgacggtatttctgggactgtttggtgtgaccggcggccggggaatcaagcagttgagccagttcaagtttaagctgtacctgaagcggaacctggaggcggtctatgcggatgagaacggcgaggtggtgtcggaggaactttatgatccgggattcaaaggcctggttcagactgcatttgcgccgccaaaagaggggaccggacggcagcttctggagaaaaaggcggatgggacctatgactaccgcaagtttttcgatgcgttggaggctgcgggacaggcggacggcgctccccgggattttgcggtccggcagtttgccgtgacttacctggatgtggcgggttataagcaggaaatcctcgcggctgaaccggaactgggcagcgatatcgcttatgagcgggcgctggagcgggccgtggacgaggctgccgtctatctgtctgcgtttcgggggctggaggaaaagctggcaatcgcgtgggacagcgatcccggcggcggctccgaccatgacaggacaacgcttcagtgcaacacaaagactgggaaggacgattattacaacagctcggttatgctgccctacggcacttacgtggtggtggaacaggttccggcagcggtgaaacaggaactggcgaaccggcattatgagcgggattatcccaaggaggtcgtgctgccctttgccccggatatcggaaaagatgagagtaccggagagacgattgtggacagcgggaccgggaatccattttttaattacaatagccaggaccggccggaggacctgatccgcaagtacaaaatccgttttaatgaagaatcccatgtgatcagggcgcaccggtcggacggagattttctgatttacaaatatgggctgaaaatggatggagcaccggaggaattgcagggaaaacacatatcctgcagcgaggtctcaggcacggtggacggcgttgtctacagcggccgtgagacggacagcggggagctggagattcgggacaacgtggcctccatgaccggggtgaatacggcggtggacggaaagtatgcggccatgctggttccctggacaatcctggaaccggcggtggaccgggttaaccccgacaccggcaatgtggagacgttgacgccgtcgggcagcggggcggatttcaattatgtagcgtacgccacagaggattttgagaacaaatacacctcttcaaagctgcggattgaaaagctggacgcgcagaccggggagaatattatccattccggcgcactgttcagaatctacgctgccaagcgggcggtggaaaagaccgggggcggcgctgcaagcggcagcgggaaggtgctgtttggcgaagccgtggatctgtacggcaaccgggtggtggacgctgcgggaaagccggtgctgtaccccagagtgggacagtccaatggaagcgacggcgacctgcctatccgcctggaccgggaggggattcccctgtacgatgagactcagttgatccggcagagggatgaagacggaaatgagaccggcatatttaaagcatattcaacggtgcgggaggtggtagtggacggcgtgatccgcaaggaaacggtggggtatattgagacttgccgtccgcttggggccggggcctatgtgctggtggagattcaggcgccggagggatatgcaaagagccggccggtcgccttcgaggtgtatggggacagtgtgcattattatgcagaaaaatggcattcggatggaaccacggacggctgggaacggattccggccgtgcggtatcagtacgcggtgcccgtacaggaggcggccaacaagtttgggacggagacggtcagccggattgaggtggaagattatccgtccagagtcgagatctacaaggtggaggacggcgactccctggtgggaaatgagaacggcctgaaagcacaggacgcctggggcaacccggaagccagcggcggttttatacaggaagttgctgtgaacgacgcgggggatcatctggtatacgaggtccgcggcaggaaggaatatctggaggagcggggagacgtgcaggatattgcctatgatccggagacaaaggagtggtacggccgcgtcataaaaaccaacgacgggtattccgagcagatcattgagggtacggaactggagttaaaggccatggatcacgttaaaccgctgtatcatccggacggcacgttctcaggaaggggaatccgattcggcgtagcggtcagcggcgccggtctggcgctttatcgcgggatagaactggaaaagactggggaaaatcagtataaaggcgtgaccgcgatctggtcggacggaaaggtggagcgcatcacggaccggaatacgggaacccacaaggaaatccgggtcaccgggtcggattccggtcccggcggactggatatctgggacacggtggaactggagaatgccccggttgacttgtatttctacgatcttcaatccgtggaaaccagatatcactcatcggacaatgagctggcggtgctggatagccgcggcaatgagatttgctttgcggattctgtcacgggcatggcttacgtgtacgacgattatggcagaatgatcgcgtacacggcggacgatcaggggcagaaggagttggtgcgttccattcagattaagcgggatggcacggtggaaacgttgtatccggataaggtcacggaggacgatgaaaacgggcttccggtttattacagaagcggttctgtgatcacaaaggaggagcggtggaccacggatcagagcgcagggccggatgggacgccggaaacggagggggcggtccaccggatcgcgcgtcttccctttggggcgtacatattacaggaggaacaggtgccttacggccagggatatgtccagccccgttacctgggaatcgtcctgcgggataccggggaagtgcagaagtatttcctttccaacgaatttaccagaacagcgttttccaaggtggacgtgcggacgcagagggaaattcagggggcggagatgaccctttaccgtgcggaggtggatactgagggaaaaccggttacggatgagaacggaaattacatcaaagaggaagttgtcgcagcctggatcagcgggtatgagtgcgacgacagggggaatctaaagctcggagaggacggagagcggattcccaccacaaggccgcactggatcgaccatattccgctgggcccatatgtgctggaggagacggtgtgcccctatgagcagggatacgttcagtccaaagccatgtccattgatgtgctggagaccggaaatgtgcagacctaccgcatggaggatgattttacatccgttgacatccgcaaatacgatacggagaatggtgagcttctctatgaggaaagcgcggcctggctctccctctaccccgctctgctggatgaggaaggtattccggtgatggatgaggccggagaacctgcatttgacccggaaaatgagattttcacgttccgcgccgccacttacagggacggccaggaggtggcggctacgggcaggctgactgcggacgcggcggggaatcatccgatcatgaagtacgattactgctaccggccgatccccaacacccttcaggggcgctattattatacggaggccggcgccacacggattgagtatttgccggtgggaagctatgtcctggtggaatccgggaatccggcggggtacgccactgctccggccatgctccttacggttgaggacaccggccatctggaaaagatccagacgtttgagatgggcgaccggccgctgacgctccaggtatccaaggtgaatattaccggaggaaaagaggtaaagggagccgcaatggcagtctatgagacagacggccagggaaatgtgtcggagcagccccttatgatccgccgtcccggcgagggcggcgcctacgaggaggtggaggccagctgggtatccggaatggacgggatctatacccgggaggaagcggaagcaggggagattccggagggatttgaggtaggggatctgaagccccatataatccgctacattccggagggggattatgttttggaggaggtaaccaccccctacggatttctccagtcggtccgcattccgtttaccatccgggataccggggaactgcaggcggtggagatgattgaccgcatccccgacggagagctggaactggtgaaatccgataccgatgagccggaaatgaaactggccggggcggagtttcagctgttgaaccggacgctgggaaacgtgtgcgggaccgtggtgacggatgagcagggcgctgcgaaatttccggcccagcccatcggttatcaaaacagccagggagaatttgccccgtacacctatgtgtgtacggagaccaaagcgcctgcgggtcatatgctgacgctgccggattttgagtttcagttccagtatgaggacagccgcaccccccttctgacggtagaataccggcctgccaacgactccaaccgggtcagggtggataaggtgatccgggataccggagaactgctggagggcgctgcactgcagattgagcgcacggatcatccggaagcaccggagagtggaaaatgggaggtggtggaccggtggatcagcaccaggcagccccattacagtaagggtttagaagcgggaacctaccgtttggtggagacgcgaacgccgggcgaggggtacccggtcctggcggagcccattttatttgtgattgaggacgggatgcgggaggtactccacctgacgatgccaaatgacacgaccgcggtggaaatcgagaaaaccgtcggcgcttcccaaacgctgctggcgggagccaggctcgcgctgatctgtaaatccgacggaagaactgtggaggagtggacgtcgacggaccagggagcccaccggatctatgggcttccagccggaacctatatcatccgggagctggaagcgccgtccggttaccgaaggggagaagatcgggaaattgtggtggaccagggtggaaaaatccaggtgtttcagtacgaaaactacaggaagagctccgggggaggcgggggaacgccggatgctccgcgggaaacctttgtcagcttccgaaagacagacaccaatggaaccgctctgcccggggcacagtttacgttttacaaccaggacgggtccgtgctgggagtgtcggtcagcgacagcagcggaacattccggattaaaaagcctgcggacggcacctacaccttccgggagaccggagcgccggagggatatgcgttaaactgtcaggtgttcagctttacggttctgaacggagtggtcgaaacgggagtctaccaggtggaggatgcgtggctggaggtgccgattcgcaagctggacggtgagacgggccgtggagtttcaggcgctgtgctgcggattacggagccggataccggaaaggttctgatggaagccgggacggacggcgagggtatggccgtgttccggccatccgggcctggtaggtaccgtttggaggaggttcaggcgccggagggctacgtgaggacggaggcgcagatggaatttgcagtgatgccggatggaacggtggaagggaatacctgcgtgtacaacttccgggaagaaaagaaaatcggcagaatcacggcctactataaaacctctttgagaggagacggagtgctgcggttcaggggacaaacgccggagctcgtcaaaacaggggacgatatgccgatagaatggattgccgccgggattttaatctgtctggccgggatgataatatccggcgggattgagcttaggagaagaaagcaggagggagatcggaaacgatgcggcccgaatgaatttgggggtcacaatgaactgagtgcaggaattccggttaagcgtgcacgccttagacggcgtatgtatacagttttcttcctggttctgctcgccgtgattcttttcctgatcccggtgtttatgccgcccgcggtagcggggcagcggctttggacggaaatacgggcagaatctttggaaggggcggggccggaaatggatggaggctctgcggttttgggtgatgaaaacatctctcagcatttcccactgacgaaagcggtggatggccgggagtatgtccgaaagagggtggaacgaaagctgatcagcggtcttccggacactgtccccggaagaatcaaaacggttctgagcgatccatttcagggtttgccgcaaaatcatattccggccgcggtgattgaatatgagggccggtgttacgggctaaaaagttatgaaaccataccggccaaaataggtggcagaacgctggaggtgaaaaagcaaatcgcatatcagaggctgggagcggaagagaatccgcctcagactgcccgcctggaggtgaaagatccggtgaccgggactgaaagcagtgcggttatgccgcttttgagcagccgtttttccaatgaacgatgggaggacggtctggatctgagggctgtggccgaggactatgacgccggagtatttcttttgggaaatgcgctggttcaactgcccggggataacccgggcgcaccttccgctgatgtcataaatgcagacctgtgcgccgccctgttggaagatctgggacttccggctggttgctgccagatcacggagatccgctgggacgggccttcgtatgaggaaaacggcacggtaaacagagacctgcgggtcaagggacggcggttggtgcgggactgcaaagctgtgtatgggggaatggctgcgctgagtccgctggacggacagcaggttcaggcggtgtacgaggagttggagccgcaggatacgatggagacagacaggaaggaagaggaggaagctgcggctgcgtcttcggtgggaaaccgccggatattggagtatacggtcgtctatgagcggtctgagataaaaggaggggatgatgtgaatcataaagaggtgaggcgcggcgccgcacggttcattccgggggcattggtggttttgttttctgtcggcctgatcgtctgctgcgccgcggctatccgggcggaccgcgggtaccgtgaggaccaggagtcttatgaggcggtccgcaaactggccaacgcagtttcggacggggagcaggttggggcagctgtgctttcgaaattcctgtccgcagcgcaccgtcccaccccgcccgccgatccatccaatgacatcattgccctgccggatattcaggaagaagcgttgcgtaaaataaaccccgaatactgcttctggatctacataccgggcacgcgcatcaattaccctgtggcgcggcattgtgacaatcagttttatctcagccacagatttgacggaggtgagggctggtgcggcagtctctttgcggactgtcgggagaagcctttatccgggccggaaacctttgtttacggccataatatgaaggacggtacgatgtttgcgggcctgaagaactatttggatgaggacttccgggtccggcattcgaacatttacgtttatgatggcggcgcgtggaatacttacgcggtggagtcgtgttcggttgccggaatggaggaacatgcgttgcaggaacgcgggcaggagatggggcggatgccggattccgtcgggaccgcccctgcgccgaccgccgccggagctgccaccgtgccgaccgccgccggagctgccaccgtgccgaccgccgccggagctgccaccgtgccgaccgctgccgggaccgcccctgcgccctctcagtatttgacgctgctcacctgccaaagcggcgggcgcaggctggtggtgcgggccgctgcgaacaggaagggggcgcggctatgagaggacggcctgcggtccggacttgttcccggatgttattgacagcactccttgggtgcttcctggcggccggcacggtttttgccggaacagccgggagccgggagaaagggcttgtgataaaccagggcgaaaatatgagaaagacgatccgccaggctacctttatggatgccgccgagcgggagcgctttgtgcggccgccggaatactacacggatgagtccggggaacgataccggctggcggactggaacgtggagtgcattccgggagaaacggctggtcacgacgcaaagaaggaggtagtttaccgggcggtggaaggggcgcaggtgattccctggcagattacagtggaggaggaccaggacggggagaacgcccggggagtgctggaaatgacggaaaaaacagtgctgggtgagagttggtccgatgaattttccgtgccggtcacctttcattcctatggggccgagcagtacgagctgggagaaattatgatccccgcgggccaggaacttccgctgtccgaagcgtaccgggaggaactgctgcgggtcctgggccttaagagcagcgattatgtggtggagaacatggtttgggacggcgaaccttatgtggacgcaggcggcgaggtctgccgggatgccgtcgcgtctgggaaaaaacgggtggcggattaccgggtggtctatgcgggacagatcgtgaggacgattccggagcgctattgcctgaaaaccgtctatgagttgaacattccggtccgggagccgtcggtgaccgtgatccgcgagaccacggcagaggcagaacagactgttccggaagacgaaagtggaaagttctggtacctgatacgcagcggggtggtggtcaccattgcagtggggctgtttgcaattttattgggtacgattgtgcttcttgcagcatggcggagggaggagagaagaaaaaagaggaaataaaaacgaatgcgccggggcttgagccgccggggggacatgtggtaaaatggcggtgacgggcggtgagcgcccaaaagaaaggagcaagcgatatgaatccggtttatgataaactgctgcgctgctatgacagcgtgaaggacagaattccgttcgcaccggacgtggcgctggtgcttgggtccggacttggggactacgcggaccacattcaggtggaggcagccatcgactaccacgagattgaaggatttcccgtctccactgtgcccgggcacaagggccgttttgtattcagccacatcgagggggtcccggtggtgctgatgcaggggcgggtccactactatgaagggtatgcgatgacagacgtggtgcttcccatccgcctgatgaagctcatgggggcaaagatcctgtttttgaccaatgcgtccggcggagtcaactttgactttgcggcgggcgatttaatgctgatccgggatcagatttcaagcctggtgccgtcgccgttaatcggtcccaatccggacgagcttggaccgcggttcccggatatgagccatatttacgatgaagaccttcgcagcctgattcgggaatgtgcggaggaacttgatatcccgttacgggagggcgtctatgtccagttcaccggcccggcttatgagagtccccaggaggtgaggatgtgccggatcctgggaggcgacgcctgcggtatgagcacggcctgcgaggcggtggcggcaaaccacatggggatgaagatctgcggtatttcctgcatttccaacctggcctgcggcatgacggatcagcccctcagccacaaggaggtccaggaaaccgccgaccgtgtggcgcccagattccgggagctggtgacaagggcaatcgggcgtatgggttcattgtagtgcgaaccagtttagaaggaatttaaaaaaaattaaagaaaaagacatagcaatcgccgtggtttcgtagtaatatgtatcatgtattcgcgccgggggctattccggcgcggataactgaggagtattttgtgagaagcaaaataacgaagaggagatactgaattatgaaaaaacattatttagccatcgcagtgctggcactggcgctgggaatgaccgcctgctcttccaagaaggcggaggagaccactgccgcccagacgactgcagcggaggcgacgactgcagcggagacgaccacggcggcggagaccaccgcagctgccgagtccgatcaggatgaggagtatttttacggatatgtgaaggaacttacggatcagatcgtgacggttgaggacgacgagggaaaacaggcgaagtttacatacgcggatgcggaattctcggatgaccgcaagctgggagtgggcgacgaggttgaggttaccttctacggcgagctgtccgacggcgagaacaaggcggtatttatcgatatcgtaacctccgctgccgaggaggccgaggaagcggctgccgaggaggaggatccggtgaccaacggcaccatcgagaaggtggacggcaaaaccatgacggtaaaaaccgaggacggtacttatacctttgacacctccatcgcccagcaggtgacaaagggaggcatcaaggcaggcgtggaagcggagattacctattacggagatcccgaggacgaggaagagccggcaatggccaccagaatcgtgaccgaggacgccagtgattctgcggatgcggatatctacatgctgaccggaaaggtgcttcaggtgaacagcaacaccgttgttctggagacctccgatgcggataagagcatctttacgtttgtgggcggggacggcatgtttgacagcctgaaggagggcgataccgccacggtcagctatgaaggaaccctgaccggacggaccatcaccgctaccggtttacagtaaattagaagagaaaatacagaatatggaaaaaacaatggcccgtcggttcaacgacgggcctattgcatcctccgatttccttgcatttgtgcgcattcccagcctggtcccggcataattggacaaaaaaccccataggctgtaaaaaggatcgatatggacggagatacccttatgatgatacccaccgacattttggcgccaaagccgcgcagagggcggctgctggggcgtatgacggagaatgcgctgttctgggccgttcttgtgcttctcggcatcggagccgtcacttcattttactatgagcagcagatcactgccgccgcaccggacaaagcccatgagtccgtttccgcgctgccggacgccgcccggcagggccagcgcatcctgcgctatcagatgcagaatgggcagctgacggtttatccgtgatgcggctttttggcatccgctcctgagttcccaattcgtgcgcgctcgaattcagagaacaggctgtcagagaaacagctccagaagaaacaccagcccgcaggcgccgcaggcaaccccgaacagcccggcgccgcggtaggcaagtaccagggcggccaggaaaccggccatggccgagaccgggctggaggtggcggtgagaatggacgggaaggtcatgaccgccagcgtcacgtagggtacataatagaggaaggaacggatggtccggttccggatgggctttcggatcagagtcagcggcagcacccggatcaggtaagtgacggcagccatgacaaaaatgtagagatatacgttatgcttcatggagttcctccttttcttccgcgtcctccaccgggaacaagacagccccggctccggctaccagcacggtcaggataatgatgcgcattcccgtggagatttggctgaccaccggcagaagggtgaacagcaggctggccgccatggacactgcgaccagtccggccaacaccttctgcttcctggccggaggcacaatcacggcgataaacatgccgtagagcgccacattcagcgcgtttaataccctggcgggaaggacgtttccggaaaccacgccaaggaacgtgcccaaggtccagctgggagcggctacgctgattgcgccgtaggcataaaaggggtttaacattctgtccgctccgatggagatgccgaagatctcgtccgtgaccccataggccaccagcaggcggtggaaaaaatgcatgttcggatctaatttctgggaaagggcgcaggacatcaggaaataccgcaggttgatgatcagctgcgtgcacgccatctccacataggaggtgccggccgtgatcagccccagagccgcgaactgcccggcggaggtcaggttggtgatggacataagcgatgcggggaaggcccccagccccacatttcttgccgcgatgcccaatgtaaaggaaaccgcaagatatcccatggcaatggggatgccgtcatgggcaccctgcagataccagtctcgattgctcttcataatcttttattctccctgtttttcaaaagtccgcccctattttaccaccccgaggggcaggagtgaacggactcttcccattttatacattagaaaatttaattgcaacactaaaatatataagaacaaaaaatagataaaaaaattagcactcacctcttgacagtgctaataaagcgtgttatagtacgactagaacacagatacaagagcacaattccgaatagaggaggaatgagtgatgaacatcaataaatttacgcaaaaatcgatggaggcggtgcagaactgcgagaagctggcttacgagtacggaaaccagcagatcgaccaggagcacctgctgtacgctctgctcaccctggaggacagcctgattttaaaactggtgaccaagatggggattcagggcgatatgctgaaaaatgaggtgaaacaggcgctggagaagctgcccaaggtcagcggaggcggccagctctacatcagcaacgacttgaataaggtgctgatcaatgcggaggacgaggccaagtccatgggcgacgagtacgtttccgtggaacacctgtttttggccctgattaagcatcccagccgggcggtcaaaaacctgttaaagatgtacaacattacccgggagacatttttacaggcactgtccacggtgcgcggcaaccagcgggtggtcagcgacaacccggaggccacctacgacaccctgaccaagtacggctacgacctggtggaacgggcgcgtgagcagaagctggacccggtgatcggccgcgacagcgagatccgaaacgtggtccggatcctttcccgtaaaaccaagaacaacccggtgctgatcggcgaacccggcgtgggcaagactgccgtggtggagggcctggcccagcggattgtgcggggcgacgtgccggacggccttaaggacaaaaagctgtttgctctggacatgggttctctggtggccggagccaagtacaggggcgagtttgaggagcgtctgaaggctgtactggaggaagtgaagaagagcgacgggcagattatccttttcattgacgagctgcacaccattgtgggcgcggggaaaaccgagggctccatggacgctggaaatatgttaaagcctatgctggccagaggcgagctgcactgcatcggcgccaccaccctgaacgagtaccgcaaatacattgagaaggacgcggcgctggagcgccggttccagccggtgctggtggatgagccgacggtggaggacaccatttccattctccggggcctgaaggagcgctacgaggtgttccacggcgtgaagatcacggactccgcgctggtgagcgccgccaccctgtccgaccgctacattaccgaccggtttctgccggataaggccatcgacctggtggacgaggcctgcgccatgatcaagaccgagctggacacccttccggcggagctggatgagatgtcccgcaagattatgcagatggagattgaggaggcggccctgaagaaggagaccgaccacttaagccaggaccgtctggcggacctgcagaaggagctggcggagctgcacgacgagtttgcggcccggaaagcccagtgggagaatgagaaggccagcgtggaccgcctttccgctctccgggaggagatcgagacggtaaaccggcagattcaggacgcccagcagcgatacgacctgaacaaggccgcggaactccagtacggcaagctgccccagctgcagaaggagctggccgaggaggaagagcgggtaagaaacgaggatttaagcctggtgcgcgagagcgtgaccgaggacgagatcgcgcggatcatttcccgctggaccggaatcccggtggcgaagctgaccgagagcgagcgcagtaagacgcttcatctggacgatctgctccacaagcgggtgatcggccaggaggagggcgtggagaaggtgaccgaggccattatccggtccaaagccggtatcaaggatcccaccaagcccattggctccttcctgtttttaggccccaccggcgtgggcaagaccgagctggccaaggccctggcggaagcgctgttcgacgatgagggcaacatggtccgcatcgatatgagcgagtacatggagaagcactccgtggcccgcctgatcggagcgcctccgggatatgtgggctacgacgagggcggacagctgaccgaggcggtacggcgcaagccttactcggtggtgctgttcgacgaggtggagaaggcccacccggacgtgttcaacgtgctgctccaggttctggacgacgggcggattacggattcccaggggcggaccgtggactttaagaacacgatcattatcctgacgtccaacatcggatcccagtacctgttagagggcatcggcgaggacggccgcatccggcctgaagccgagaccgcggtgatgaatgatctgcgggcccacttccggccggagttcttaaaccgtctggacgaggtgattctgttcaagcccttaaccagggagaatatcggcggaatcgtggacttgtgcgtggcggatttgaacaggcgtctggcggaccgggaattgaccatcgagctgaccgctcaggctaaggagttcgttatcgagcggggctatgatccggtgtacggcgcgcggccgctgaagcgttaccttcagaaacacgtggagacgctggcagccaaaatcattctccaggacggtgtccgcgcaggtaacaccattgtgatcgacgtgtccgaacatcaggaccggctgatcgcctatgtggagtaatttataaatatttggaatccatgagaaaaaggcgtggggggcctatcctgcgcctttttttgtggaaaaaccactggaatttgcaaaaaatgagcgaaattgggaatgaagtcttgacaatgaaaaacataagcgataataatattgtgaaccggattccaactgggtccgggtcagatgattctgcagagacggaggaagaaaacaaaccatgggcagtataccgaaagatccggttattttattgagctatataaatacgcagctgagggatcactatggcacgcttgatgagttttgccgttctgccggtgtacagaaggcggagatcgtctccacactatccggtatcggttataaatatgagccggcgcagaatcaattccgttgaaacgccttgtatcaggccatgagattatcgcagccgggcggctttatctgatcggaatccatcggataaggccgttttttgtacgtctgtgggaaacgaaagagaaggggatgaaatggcacgttaccgctataaagcgctccggatggacggcacctgctgcgcaggaacgctggaggctgcggacgagcagtcgctgcttgagatgcttcaccggaggggaatttattgttacgaatatcgcagaacagaggcggagaacggccgtcggacttccagcagagtgaagtccgacgccatcccgcctttctgccgtcagatgtccaccatgctgggcgcgggcgtgcctgtttccagagcgctttccgtctgcggcagttccacccgtgaccgctcccttgggcggattctggcccggcttaacgagacggtgcagaaggggcggacgctgtccgaggccatggcggagatgaacgggatatttcccggactgctggtccatatggccgctatgggagagctgaacggttcattggaccgggtgatggcgaaaatggcggatcattacagccgggaggcaaagctgcgcaagaagatccggagcgcaatgacctaccccgccattttgctggtggtcacgctggcggctacggcatttatgctgaccgccgtgctgcccaggtttgcgtcgcttttgtccggaacggagcttccggcgttcacccgtttcctgctggggacgagcgcgtttctgaaaatccacgggctgcatctgctgctggctgttctgggacttttggggctgggagcctggattttgacgattcccgcggtccgtctggaaaaggaccggctgcttttggggcttccggtggtggggaggctgctgaaaaccgtgtacacggcccagttcgcctcgtccttttccctgctgtatgccagcggtatcagcattttggaaagcctggacgctgcagcggccgtgatgggaaattcctacatacggatgtgtctggggcaggtgggaatggacctgcgcaagggagaaatgctctcccagtcgctggaacggcggcgtatctttcttccggtatttatctcactggtggcggccggcgaggaatcgggcgcgctggagagtatattggcggatgcggggatcttttacgagtcggaatccgaaagggccctggaacagatggttgcgcttctggagccctgtgtgatgatcgtgatggccctggtggtcggaagtattgtgattgccgtcatgatgcccatttacaccatgtattcccatatgctgtgatgaggaggaaatcgttgagacattatctctatctggaggacaggcggatcgcctatgtgtgtggttgctttaagggcggagtgttcacgctgcgcgctgcaaagaccgcagaattaaccagtgccggggacgtgcaggaggcagtagcgtttctgcggtcagcgggcctggccggaaagcgcgtgattgcggcggtgggtggaagcgagaccgttttgcgtgagatgcgccttcccgcggcgtctgcggagattacgcggggaatgatccgaaatgaaatcgcctattttcggaaaacggccgcggccactgcggtggacatggatctcctggagcgggcgggacggggaaaggagcagcatctcctggcgtatgccatggaactggaacggttagagaagcggctgctgcccttaaaggaggccggtatttcctgcgcacgactgagcgtgctgccggactgtatggcgaagtttgcctttcgtatgggagcgcgccgccagaccgccgtggtggcggcgctggaatcggatcagctgcgcctgttcctggttaaagacgggcactgccttataaaccggaatgtccggttgaatgtgaggcgcttctgcgacgctggagcggagggacttctctatgaggagattgcggatcagatcggaaagctggtccagttctgcgaggcccgcacggagtcggagaccgtgcagcaggtgatgattctcccgggcagactgaaggacgcggatgcggcggccgcttctgtgggcggtctgctcaggctgccctgccgctgtctccggtgtgacatccgcccggctgggaaaagccaggtggcagaggaggacattcacttcagcgcgatggtgctctgcgccgcccaccggcctgagaagggactatccccggtgaatctcctggccgcggagcgcggattgtcccggcgcggaaggggaatcctgccggagggattcggcgcccgctgcctgttgtttgcagcggccaacgcgctggcagtggccggaatctggtgttatctggaggccgggacataccgcgcactgcaaaaatcccgggagctgtccgcctacctgtcggaggataaaggcgtggcggcctaccgggagaagatggccaaatatcaggagcaggccgatgatcgcgcttaccagagccggatggaggcggcaaagaaccggatccgaacaatgaaatgcctgaccatggaaggctttgaagtcctggagaattgcctggctcccggtatggacattgagtccgtggtttacaacaaagacacgggatacctcagcctgcgcatcaccataccggattccggggaggcgcccggatatgtggagcgcgtgcgggacagcggatattttacggaggtggaatacagctcctggggttacgggacggaagccgccgggaaacagaagctttccatggagctaaagatcaggctgacgggaaaggagggacggcaaaatgcggttcagtaaacgggaatgtgtactgctcacggtgctggcggtccttctgatctggtcggttggccggagccggattctggagccggccatggagcgccgcatgtccgcccgtgaggagtgcagccggttggagcgggagcggattgaggcggaacagttcatcgacgtggtgattgtgtcggagccaactttggaggaaagcggggaccggttcttttatgaaacgatggaggatgtgacctttgaccgcctgtttcagcgcatggccagggagtccggactgacggtccgcagactggaaatcatccggtcagagtccgggaagggggatttccagccggagagggctgtgcccagggcggaaagcacggacagtgcgggaaattcaggcggcgcggggagttcaggcagtgcggggaattcaggcagtctgggaaatgcctccggcccggagttccggtacgcgcagattcatttggagctggccggcgacggtgttcgggatgcaatgaggatggcggaccggattgacgcagagcctgccagcatggtggtgagttacatgggaatcgagccggacagccgcgtgaaggcctcggcatcggagacggccggcgtgatctgccggatggatgtggatatttactgggtggagccgcgtgcagcggagaaaggcatggaataggcgatatggcgtacaaaagaaagggcgggccgggcccaagggcgggattttcattggttgaggtgatcgtcagcgtggcgctgatcgccctgatcagcacgggattcctgtatatgatggcggcaaactcggagcttctgtcgcgggagtaccgtttggaccgttccagctatgagctcggcgcgctggcggaccgcggggagggaagggccggggagaaggttctcacggtgtatttccaaatggattccggtgaaacgctggaagagtattttcgcgagtacacggttggggaagacggggaaaaccggattacctatttccggcacgagtaatgggaggacatggagtgggcaaagacacagaaagcagggccaggcgctgcggtggcttcacactgctggagaccgtaatggcattgaccattgcctccatcgcgctgctctttttcaccggttttctggtgccccagctgaagctgtattaccggttcgggcggacctcggaggcaaaacaggtatgcggccggatttaccgcgagatagaggaacagctgcgttacgggtatgatttcgccgtagaccccgaagatcccgcaaccttgtattaccgtgtgcgggagacggaacggtccggggacgggtaccggagcggcgtaggggaagatgggccgctgcaatttgacggggcgctgctggatggagggcaggagcttggcatgaggctggagctggattttaccggcacggatgaggacgcggtctgtgtgcggattcaacttttggaagaaaatggggatgaagtgatctgggaacagagggcctatgtttccagcctgtacggggagatagaggagggaaagccggatgggacgcattgatccgcgccagggaggcagtatgatttacgtggtcatgctcatgacgatgtttgcaattctgtccacggggtttctgtacatgtcgcgttacagtatggaagcagttttacaaaaccgcagctacatggaagcgcaggccaccgcaaagatgatccaccagtcctactgcctggacgtgagcaacggctcatccgctgcgatgaaccggatttgggaggaatttgaggaggactgcctgtccctggcggggagaaggggcgcggcagagcttacagaggccctggaagccttggaataccgcgcaaatggatacggcgaaacgggagaccttgcggtggagatggttctgaccgccagaccggccaggggcgaggccaccgtggacactcaggtgacatggcatggatatacgttcaggctgggcgcggaaatccggtttgacgacgcggaaggcgaagtgttgatcattccgctcccgcaggaggatgagcagggggaagacggggaccaggatgaaggggagccggacagcggtctggaatcagatgaggccgccccggacagcgtcccggaatcagatgcagagcccacggacaacgccccggctccggatacagaagatccacagactgcagtctccgacagcctgtactttaacatgcagggcctgggcgtctaccgttactacgagggcggatgttcctggtaaacgggccgcgggtgtggaaactgtctcaaacccctccgcaaaacaccagattcagataccagctgaggatttgttcgccccaaagcagcgagagaatcagggagacggcgaaaaaaggagccatgggaatggacgagcgacgatggattttaccgcgtagcagtgccggagcgacccagacagcggccaggacatagcccccaagcatggcaagaagccccctcgggaggccgagatagaagcctgctgcggccagaagcttgatgtcgccgcctccgattccgccgccggtgagccgggagacaatgaacagcgcagatccgatgaggacagccgcaacaacatgatcgcccaagcttctccaggaaaaccgcgtcagaaggccgcaagcaggcagcgggataaaggagatgagtccggccagaaggatgaacagggagatgccgtccggtatgtaggtgaaatcccagtcgatccaggccgcggcgatcagggcggaagcgaacagacaggccggtacggactggaatccggccccgaacacgtaaaagcagagcagaaagaccagtccggtcaatgcctcggtcagcggatagcggcgggagataggccggtggcagtagcggcatctgccgcgcagaaacagccaggagaatacggggaccaggtctcccggactcagggcgtgaccacagcgggggcaggaggagcggccctttattggggagagccggcggggaaaacgccacacacagacgtttaagaaactgccggtccataagccggtgaagagatacacggctccgtaaaacaggttgtacacttccataaaactctcctcccggtcggattgtcggttacagtatagcatttacatgagaaaggaacaatcttaatatgaatattccggtggaaacactgttgcttgagcgcggtttgctgacagaacgccagctcagacgcgccatggaattcagggagcgctgcccggacaaggccctggaagagattctgctggatttcgggtatgtttcggaggcagcgctgttggcctgcctgggagagcgggacggcctggaggtggtggacttgtcggagtacaaggtggatcccgaggcggccggactgatttcccacaacttctcggatcagtatcaggtgcttcccatcggcatacggaacggaaagctggtggtagctgcgcgggatccgctgatgtttgatgtgttcgacgagatcgaggccgcggccgggatggagctgaccgtggtgctggccgccgcagagtccatacggaattgcgcggccgcggtgtaccgggagcaggatttgagcaacgcggtgcagaaggtgaacaaggaggttctggggtcgggctacagccgggaggtctccgcggccagcgagcgcgtggagggcacgcccattgtgaaaatggtcaacacgctgattgagcaggcatatgccaggggcgccagcgacatccacgtggagcccatggaggaccggcttgtgatccgtttgcgcgtaaacggcgatctggtggagcacgcatccatggcaatggaagcccaccgtcccatcgtgaccagactcaaaatcatgggaggcatggatattgcggaaaagaggctgccccaggacggcaagtaccgctatgaccgcgggcaggtgaaaacggacctgaggatttccgccctgcccacaatttacggtgagaaaatagtgctgagacttttaaacagcgcccgggacgactgtctgatggatgtgcggcgcttgggtatgacggaggaacaggaggagatattcgagcggttcataaaagcgccctacggcctggtcctggtgaccggtcctaccggaagcggcaagaccaccacgctctatgctgcattaaaccggctggtcaggcggaaaatcaatgtggtggcagtggaggaccctgtggagaaggccataagcggagccactcaggttcaggtaaatgtgaaatccggcctaacctttgccgtagccctgcgggccatactccgtcaggatccggatgtgatcatgatcggcgagatgagggacggagaaaccgcatccatcggcgtgcgcgccgccataacggggcacctggtattttccacgctgcacaccaatgactgcgcggccagcgtcgcaaggctgctggatatgggcgtggtcccctatatggctgcggcggccctcaccggggtgatcgcgcagcgcctggtgaaggagctttgtccgcactgccgccgggagtatgaaccggacggccgggagcgggagcttctgggaggtacggccccggaaccggtaaaacggctctggaagccggtgggctgcagccgctgtggtaataccggttattccggcaggcgcgccatctacgagtttatggaggtggacgaggagatcggcggcatgatacaaaaaggggcttcgccccgcgagatacggaccgtgctgcggaaaaacggaagcaagagcctgcgggagcaggcaagggatatgaccatccggggagaaacttccgtggaggagctggagaagatcatctattccgttgaatgaggacagaaaggaaaacatatgaggagaactgacagaaagcgcaagacgaacggagggtttacgctggtggagctgatctgcgttatcgcaatcatggcaatattgattgcggtggcagtgccgtcctatcagaacatgcaaaataaatccgccgagcaggtagccatggccaacgccagatccgagtattccgcgggcaaggcgcagcaggctttggtggatgcacaggtgctgaagccggatgagacggagtcctacgattacgatcccatcagcgacaccgccacctgggagggcgagatcaacgggaaaacgtacaccgcaacatttgacggaaaatcaggggaggcaacggttaagcacaaatagcggcagagtttccgatgagggggatttcttgccaaaggcgcgcatttatggtacaatgggccattgtcaggggccggtctccgaatggaccggaactattgcaggaccgaaaaagagatgggaagaagagtgaatcagaacaaaagaggcggttatacgctggtggaattggttgccgtcatagcaatcattgcgattctcgtgacgtcgagtctgccccatatggactggctgacgaaagcggccaggcgcgtggcttcagagcacgaggccgttgaggtggccaacgcggcgagacggtatttgcaggataaaatggacgcgggagagctgcctggtaaagcggcttttcatttgatcaatctggagctggataaaccggataatgtgctgcgggattatatcggcggaggcatggagggcgcgcggatcgaagcgctttttatcgacgcggaaggcatcctgggttatatcacctatgtgaatcagtttgaccgcgttcggataagctatgacaacgagggcagacagaccgtggagcacgtgggcccgggaatatgagaaagagaggtggccggtaatgagagaaatatggcagagcacggtggaggtgtggtcctggctgatgcagcatctgtggtttatcaacgtgctgctctccatcgtgatcgtatttttccagcgccgggatcccaagaccgtgtggacctggctgctggccatctattttatccccgttttcggggttgcgttttacctgctgttcggacaggatatgaagaagagccgtatgttccgggtgaaagaggcggacgaccggctgaagttccccatcaagagccaggaggccgtgatccgctccgagcgcagagaggaccatcacccggatgccatgaccagggagtacagcagcctggtgctctacaatctggagacttccggcgcggttctgacctcggacaacgcggtggatatctacaccgacggccgggagaagtttgaggcgctgcgccaggcgcttcggggggccaggcgttttatccatattcaatactatatcatcaaaaacgacgaggtatttgactccattgtccccattctgatcgaaaaggtcaaggagggcgtggaggtccgcatcctctacgacggcatgggcgggcggtttatgcccaagcggcgctgggaggagatgcgtttggcaggaatccgggtgggcaccttctttccgccctttcttggctggctgaatctgcgcgtcaattaccgcaaccaccgcaagatcgtggtgatcgacggcaccaccgggtttgtgggcggcttcaacatcggccgggagtatatttccaaagatccccagttcggctactggcgggacacccacttaaagatcaggggggaggcggccatcagtctgcagatccgttttgccctggactggaattatgccaccggagaaaatctgttcaaggacctgagttatttcggggacgaggccgaggcggccagaagacgccttatgggcgaaggaaacagccgtatctggccccaggaccaggcggacgcagagcaggtgtatatgcagattatcaccagcgggccggataccagggagcctcacatccgcaataactacctggagctgtttcacaaggccaagcgccatatttatattcagacgccgtattttattcccgacgacgcgattctctccgccctgaaaatcgcggcttcctccggagtggacgtgcgcctgatgatcccctgcaagccggaccacccctttgtgtactgggccacctgctcctacgcgggcgaacttttggattacggggcccgctgctatgtgtatgagaacggattcctgcactccaagggcgtgatggtggacggacaggtcagctgctatgggaccgccaacatggatatccgcagctttgagctgaatttcgaggtgaatgccacgatctacgatcaaaagaccaccgagcggctggagaaggcatttatggacgatctgccccactgccgggagatcacacgggaggattaccacagccgcagactgtggatgcgcctgaaggagcagatgtgcaggctgctgtcgccgcttttgtaaaacggcggggccgcggtaagttctggaaatgaaaaatccatgtatggcacggcggggcttttgtccatactatggtttatgaaaacgctgaatttaaaacaatttttgattaacttctgccgctgcggcattgccggttggtgcctggaggtgatgtttacctccgtggattccatcatggccggggactggcggctgatgggcagaacttctttaataatgtttccgatttacggcatgggcgcgcttttgggacccatcagcagcatgatggacagctggctgtccgatctgcccggctttgaggaggcctcccgggagcggatcagtcccctggctctggccatccgccacgggctgctgtttatggtgatgatctttattgcggagtacgtgaccggaatctggctgaccggcgccggaatctgtccctgggactactccagatggccggacaacgtggacggcgtcatccgtttaaattttgccccgctgtggttttttaccgggctgttgttcgaacgaatcacaaaatcaaagagcagatcatgatacgaaaacctgtttccagggtattgtatttgatctgctattttaatataatagaggaaaaatatccatgaagtggaaatgattctgtcatggttccgccgcgttggataaagatgacgtacatagtaaggagaacaccgatgttaaggattattttggtcgcatcgaccgtagtgctgttcctgattttcagtattccgattctggggattctggcgctggtgggtaagggaaacagccgcgcaaaacaggactggagcctgcggatcgtccgcagcgtgttccggttcatcctgaagctggccggcgtgaccattaccgtccagggcctggagaacataccccgggaccgggccgtactctatgtgggaaaccaccgcagctactttgacatcctcaccgggtatgtgaccgttcccggcctggccggatttgtggcgaagaaggagatggctaagattccgcttctgagcacctggatgtcttatgttaactgcctgtttctggaccgggtgaacatcaaggagggattaaagaccatcctggagggcatcgagaaggtgaagtccggcgtctccatctggattttcccggaggggacccgcaacgagggggatttgacggacctgctgccgtttcacgagggcagcttaaagatcgcggagaagagcggctgtccggtgattcctgtggccatcaccggcacggcggaggtgtttgaggaccacctccccctgatccgtcccagccacgttgtgatccgctacggcgagcccatcttcctaaaggagctggagccggccaagcggaagttttccggcgcttacacccgggatgtgatcatttccatgttaaacgagatggaaaaagaaaaaaataattgacggagaaagacaacctatgaagaacctggatttgggagaattgagaggacagctggacgagatcgacggccagctggtccgcctgttcgagcagcgcatgaaaatctgcgcggatgtggcggaatacaagatagagacgggtaaggccgtgtacgacggggagcgggaacgccagaagctggaagcggtgggtgcgatggcccacggcgactttaacagccaggcggtgcgggagctgttttcccagctgatgacggtcagccggaagcgccagtatcagctgctggcccggcacggcaagggaattgacaccggattccaggtgatcgaaacaattcggacgtccggagcgcgggtggcgtatcagggcgtggagggctcctacggacacggggcggcccttcagttttttggccgggaggcctcgctctaccatgtgacggccatggaggacgtgatggccgaggtggaggaaggacgggccgactatggagtgcttcccatcgagaactcctcggcgggagcggtcagcgacaattacgatctgctggtgaagcacaacaactacattgtggccgagacgcagctggcggtgcgccacgcgctgctgggactgccggaggcgaggcttgaggacgtggagcttgtctactctcatccccaggccctgatgcagtgctcccagtatttaaacgcccatccccagtggcgtcagatcagcctggagaacaccgcggctgcggcgttaaaggtcacccgggacggagactgccgccaggcggctgttgccagcgagatcgcgggcaggctttacggcctcaaggtgctggccccggggattaaccacaacaagaacaataccacccggtttatcgtgctttcccgggaggccgtgtaccgaaaggacgcgtccaaggtcagcatctgctttgagggacttcaccgcagcggctccctgtacaatatgctgggcaatttcattttcaacaacgttaacatgctgatgatcgagtcccggcccatcgaggggcgcagctgggaataccggttcttcgtggacgtggagggctctctgggagacgccgccgtccagaacgcgttaaaaggcatctccgaggaagcggtcagcatgcggattttgggcaattattagataagagggtgagcgacatggatacaaaacagttgattatataccgcaacctggaataccaggagttatttgaggagttcgccgggctgctggagggcgccggggagcaaaaggacgccggaagccgggagagcgccggggagcaggagggcgccggaagccgggagggcgccgggagccggaaggatgccggaagccgggaggcggcgcttgccaaccagctgatcgagctggcggtgacctacggctttgagggcaatttatggcactgcttcatggccttctgtctggccaacaatgagaacgcctacagcaccacctgcgagatccagggcggggcgggcggctctttggaccagctggcgcgccgggatttcgccgtgttcaaggatctgttcgaccgggatatccgggttttgggcggaccggtgtgggagatgttagcggcctacaaaccggcccggacggacagcaaggtatttaacaagcgcatccgcgaccgcatcgtaaatctggcggtccaactggagcaggcggcggacgtggacgccttccagcggctggtggtggatttctaccgggagttcggcgtaggtaaattcggtctcaacaaggcgtttcgggtggtggagaaggaaaacggccagcaggtgatcatcgatcccatcatcaatgtggagcacgtctacctggacgatatcgtgggctatgagctgcagaagaaaaagctgatcgagaacaccgaggcgtttatccgcggaaaagaggccaacaacgtgctgctctacggagacgcgggcaccgggaagtccagcagcgtcaaggccatcctgaatgaatattatcaccagggactgcgtatcattgaggtatataagcaccagtttaaggcgctctccgacgtgctggagcagatcaaggaccggaactacaagttcatcatctacatggacgacctgtccttcgaggactatgagctggagtacaaatacttaaaggccatcctggagggcggtctgggaaaacgtcccagaaacgtgctgatttacgccacctccaaccgccgccatctgatccgggagaagttcagcgacaagcgggagctggacgacgagcttcacaacaacgataccgtacaggagaagctgtccttagccgcgcgcttcggcgtgacaatctactacgggtccccggacaagttccagttccagaagatcgtcagcgtgctggcggagcgctaccacgtgaaccttccggaagaggagctttacgccgaggccaacaagtgggagctgagccacggaggactttcaggcagaacggcgtcccagtttatcacccatctgctgggcaccctggtggagtaggttttacacatattttacgggaaatttaccgggattcgctgcgcgggagccgggaatccggtatcatggaaagagagaaaaaacgtcggatgaggacggccccggccgttgtttgcggggaggggaggaacaaaagtggcagttcaattatttgcggcaatcgatgtgggctcctttgagctggagctgggcatctacgaaatatcgggaaaaaacggcgtgcggcgcgtggatcatatccgccacatgatcgccctgggaaaagagacatacagcgagggcaagatcagctacgaactggtggaggaaatgtgccaggttctggaagattttgtaaaaaccatgaacgggtacaaggtgaaggggtaccgggcctacgccaccagcgccatgcgggaggccaaaaacaaccagatcatcctggatcagatccgcgtgcgcaccggcctgaaggttcggatcatcagcaactcggagcagcgctttatcagctacaaggccatcgcctccaaggcgacggagttcaacaagatcattcagaagggcacggccattgtggacgtgggatttggcagcgcccagatttccctgttcgacaaggacgccctggtgacgacccagaacctgtccctggggtccctgcgcatccgggagctgctggccagaatcccggccagcgccaaggcccacagggaacagatcgaggagctggtggacaacgagctgttcaccttccggaaaatgtacttaaaggaccgggagatcaccaatctgatcggaatcggggaaaatattctctatatgatgcgccagatgcagtccaagcccgtgggggataaggtggaggcgtcggtgctgaacacattttacgagaaatttaacaagctgacgctggatcaggtggaggagcggtttggggtgaacgcggagtacgcctccctgctcatgcccacggtggtggtctacaagcggattctggagctgaccggcgcccagatgttctggattccgggcatccgtctctgcgacggcatcgcggccgagtacgcggacgacacccgcctggtgcggttcagccacagctttgagaacgacattctggcagcgtcccggaatatggccaagcgctacaagtgccacgccagccacagccaggtgctggaggagtacgccctgggcatcttcgactgcatgaaaaaataccacgggctgggcggacgggagcggctgcttttgcagatttccgccatcctgcactcctgcggaaagttcatcagtatgagaaattccaacgagtgttcctataatatcattatgtccacggagatcatcggcctgagccatctggagcgggagatcatcgccaacgtggtgcgctacaatatccgggatttcgactatgacaaggtacagctggagggcacgtaccaggagggcaccgtggaactggaccagaagggcatgaccattctgatcgccaagctgacggccattctgcggctggccaattccatggacagaagccaccggggcaagctggcggactgccggatgagtatccgggaaggggagctggtgattaccacgggctatgagggggatatcgcgctggaggccatgtcgtttgagcagaaagcagatttctttgaggaaatttacggcatacggccggtgctaaggcagaagaggaggatataagccatggcagacgcagaaaagacgaagagctccaaggcttccaaggcgaaagccgcggacgccgccgggaaaaaggcggctccggaagccggagcggaacatagagcggcggaaaacccggacgtggaggacaacacccaggtagagcgggaaatagacgggaaagccgcgggtaagccggaaccgaagaagaaagccgcgggtaagccggaggcgaagaaagaagccgtgggcaagccggagacgaagaaagaagctacgggtaagccggaggcgaagaaagaagccccaggcaagccggagacgaagaaagaagccgcgggcaagccggagacgaagaaagaagccgcgggcaagccggagtctaagaaagaagccacgggcaagcctgagtctaagaaagaagccccaggcaaaccggaggcagcgaagaaagccgcgcccaaacctgcggccgtgaaaaaggcagcggcgaaatccggcgggcagaagaagccggctgtggcggaggaacccgcacaggagccggattttggcgcgaacccggacaattatgtcaaccgggaactgagctggctggaattcaactaccgggtgctcagcgaggccagggacaagacgctgccactgtttgagcggctgaaattcctcagtatcaccgcctccaacctggacgaattttatatggtgcgcgtggcctccttgaaggatatggtgcatgccaagtacatgaaaccggatatcgccgggatgacgcccaccagacagctggaggccattgcggaacggacccatcagctggtggacctgcagtattccacctacaaccgctccctgctgccggtgctgcgcatgaacggcctgcgggtgatcaccgagcatgaggacctgacggaggaggaggcgcgctatgtggaccggtatttcaacgagaacgtgtatccggttctgacgcccatggccttcgactcctcccgtccgttcccgctgatccgcaacaaaactttgaatattgcggcccttctccggaaaaagaacggcgaggaggacgatgagttggatttcgccatggttcaggtgccttccgtgatcccgcggatcgtggagctgcctgaggagaaggacgaagagggcaatccccagcgggtggtaatcctgctggaggagatcattgagcgcaacatgccgtccctgttcctaaactatgatattatcgcctcccagcccttccgcgttatgcgaaacgccgacttaaccatcgacgaggaggaggcggtggacctgctggaggagattcagaagcagctgaagaagcgccagtggggcgaggccatccgtctggaaatacaggcgggcgtggataagcgcctgctgaagattctgaaaaaagagctgtccatcagcagccaggacattttcgacattggcggtcccctggatctgaccttcctgatgaagatgtatgggctgaggggatttgaccatctcaaagcgcccgggtatacccccaatccggtgcctgcgctgatgaatgaggacgatattttcaccaacatccgcaaaggagacattctcctgcaccatccctaccagagcttcgatccggtggtgcggtttgtgcgcagcgcagcccgtgacccggaggtgctggccatcaagcagacgctgtaccgcgtcagcggcaactcgcccattgtggcggcgctggccgaggcggcggacaacggcaagcaggtgtcggtgctggtggagctgaaggcgcgttttgacgaggagaacaacatcaactgggccaagaagctggagaaggcgggctgtcacgtgatttatggccttgtgggattaaagacccacagcaagatcactctggtggtgcgcatggaggaggacggcatccgccgctacgtgcacctgggtaccggaaactacaacgattccaccgccaagctgtacacggactgcggcatcctaacctgcagtcctcagatcggcgaggatgccacggcggtgttcaacatgctgtccggttactccgagcctctggcctggaaccggctctcagtggcgcctctgtggctgcgggcgcgctgcctgcgcatgatccgccgggagacggaaaacgctctggctggacgcgaggcccacatcatggccaagatgaattccctctgcgacaaggaaatcatcaccgccctgtatgaggccagccacgccggggtgaaggtggagctggtgatccggggcatctgctgcctgcgcgcaggcgtgccggggctgagcgaaaatatctcggtgcgctccattgtgggcaatttcctggagcacagccgcatcctgtacttttacaacgacggcagcgaggagctctacatgggcagcgcggactggatgcccagaaatctggaccgccgggtggagatcatgttcccggtggaggacgaggcccttaaggccaaggtgatacacatcctggaggtggagctggcggacaacgtgaaggcccatatcctgcagcccgacggcacctatgagaaggtggataagcggggtaaggttctggtcaattcccagcagcagttctgcgaggaggccacagccgaggcaaaggcggtatttgaggccatggatccggcggtgacgcgaattttcaagcccattgagagcagcaactaaaacggcgtccgtggcctattatttccaatcaatcaaacagccggtacctctgtgcgtgaaggatcgcacagaggtaccggctgtttttgcgggtgcgcccggcggtggggtgggaagcccgttggattttacccacagcgtgctctcacggctccagccgtccggaggcgttttgcagctgcttgggcgagtagccgaactgttttttaaagcacttggaaaactgggccacatccgggtaacccacctgttcgccgatctcgtagatccgtaggttgccctggcgcaccagatcgtaggcgatgttcatgcggtgcaggaacaggtaatcgctgaagggacagccggtgtcgtccttgaacacggagcttaagtaggaggggctgacgtggagctcccgcgccacggattttaaggagaggctttccccgtaccggctgcgtatgatggccagcgtctttttcgtgtaggggctctggcaggaatcccggcggacctcggtgaacaccatggtgaggatttgatccagggctgtaaacagatcatagagattgttgggcttccgcagccgctcgatgaaaacgtgcatgtccaggcccgcgggcaggggaagcccgtagacccaggtcagctgtttgtaaattgtttccaaaaatttgaagcactcaaactggaagtccagatgcttgcaggtccaccggttttcccggcagaaccggagaaactggctgagggctgttttcaggctggtctgatccaggcttttgatcacctccggcacaaggttctgctgaactggatcaaagagaacccggctttccggggctggcaggcgcgtcagcagcagcccgcacagcgcctgttgcaggagcgcgtacagggaggagtccggctcttcccggcagaggcgtaccgccagatctgcgctgccgtccagggttttcttcgccgtgtcgagcgccgtctgttccagatccggggcggtgaaaaagcagcagcaggccacctgatcggagacccgggcctggtaggaggccagaaggggcaggtcgaaaccgtccagagcgccgggattgggaggcgagccggtgacggagaccagcaggaacgggcggctgccctccggcgcgcccgccaggcgggccagatgaaggaaggtctggtccgcctggggcacattggtcagggcgtcggtcagaattttttccaccacggtccggtcgcagttctggccgctcccgtcctctgtgctgcggattttttcagcgcagcgccgcacgcagtccagaagcacatccgcctcgatgggctttaacaggtagtcgaaggcccccagcttgacggcctgctgggcgtactggaattccgagtagctgctgatgaagatggcctcgcatttcagcccgcagtcccggatctgccggaacagctccaggccgctggcgtcgggcaggcagatatcggccaggatgatctgtggacggtgcagggccgcggcccggaccgctccggcgcagtccccgcagaccgcgcatacctccactccgagggcggcccagtcgatgtaggtgaccaggccctcgcggatcagtttttcatcgtcaatgatcatggcttttatcatatgcttcatcctttcgggaaatcgatggacacggtggttccggcgtccgggctgctgtcgatggtaaagctgtagttgtcgccgtaatagaggcggagctgccggttgaggttgatcagggcaaaatatttgccgtcgctgcggtcctcgcggatgcacagattgatgtcgtttaagtccatagacgtgattccggccccgtcgtccgtcacgcggtagcggattttgccggactccaccgggctgaagctgaccgtgatgcgcccgccgcccttgggccgcaggccgtggaccacggcattttccagaaccggctggaaaaagtatttgatgacccgctggtcccggatggaatcgtccatctcaatggagctttcgatggttccgtccatacgaacgtttaagagggataagtagctggccagaacctcggcctcccgctcgatggtgatgtagtcgctgccgttgtttaaggtgaggcggaaaaagcggctcagatcgaaaatgatcttggaaatctgaggcacgttattcttgtccgcgatccagtggatggaatccaacgtgttgtagataaaatgttccttcagctgggtctggatgaatttcagctcgtaaccctccttcaggagtctcgtctcatagttggtgtggatcaggctgtcgatattttttaagagaacgttcagccggtggccgatgtagcccagctcgtcccgccgccgggtgtggatgcgcacgtccaggtcgccgtgctccgcctcccgcatcttgtcgctgatctgcttcatgggccggatcaggtaaaaggagacgaacagggcggtgaggatgaagataaagaccaacgtgatcacgatatagaaccaatactcggtcatcaggggttcggacacattgtaatgttccagaggcaccgcggccgcgtagtaccagccggtgtactgggagcggaagtaagccatcaggcaggggactcccccggagttaaagggcacccacccggacacctggccaggcgcggaaatgggcaggtccgcagtgtccaccgtgttggggccggaaatggggatccactcccggtttcggggccggatatagaactggatggcctcgctggggtcatagaccttgatgtggtcgtgaagggtttccgtggagataatggcccgggaataggtgtacatgttgggattgaaggcgcagaaggggcggctgtaggtggcgaacagggtctgctcggggtccgaggagagcacgtaccaggcccggttgccagtcagcccggttttctgggcgttctgacggatattttcaatctgggtttccgtggggttgattgcgatctgacgcgaattgccgggagagttgccgaacagcgtgttgccgtaggagctgtacacctccagggagtggagataggggttgcttaagtagagcttgtacagctccatgctcagctcctgccgcagccggtagtttcggtagcccaccccggcggaatcgtccacggtcagccggaaacagtcgttggagaaggcggtgttgccctggagctgggactgtacgaaattcacgctgcggaacacctcgtccatggtgttggagatgctggtcagggaggacagcagctgggaagctccctccttctgggccagccgcttggaggtcccgtaaagggaggcgtacagcagaatgatgggcaccgcaaagatcagaaaatagataaacaaaactttcaatagcaggctgtggttgtagtttttcttctttcccgccaatttcatcggttctcccctctgtctcaaatctcttcatacttattttaagggaatttttcaggaaaacaagtgttgacaggccggatttccgaaggcatcgtgaaataatgtgattaaatcactaaaaatcgtataaaaagacaagatgaccgaaaaataatcgaatcgattcacaaattagaaaatcggctgccattccgaaaaatcaggggagattctataatgatttcagaatcagaccggggagggacggaaacatgacagtatacatcagcaacctggtggcagggctggacaaggggcttgaccatacggagctgttgcttgagatgacggggccctttggcgggcgtgtgggaatcgagtttttcatccatacctactcggaggcgtacatggagcggatggagcatatcggaaaatgggcggggaaactgccgctggccctccacggcccctttctccaggtggaggccaccagcgctccgggtacggcggagtacggcgcgctgaccgcgtcctacggccgggcgttcgctctggcgcagcgctttggctgcgggcacatggtatttcacgaccacgagcgctttgtgaggccggaacagaaaatggacctgcaggcccggtgcctggaaaacaccggcgagctgatccgcctggcaaaaccctggggcgtgcgcctgctgctggagaatctggcgcttccggtcaaggggactccgctgtttgaccaggacgagtacatcgggctgttcgaccggtttccggacgcggactgtctgatcgacgtgggacacttgggggtggccggctgggatatggagacggtgatcggcagtctggccgggcgcatcaagggctaccatctgcacaacaacaatggaaccgacgacagccaccgccggatccgggacggcgtgatcgactacgaccggtttttccgcctgtaccgcgcttatacgccttctgcggacctgacgctggagtacggcgacaaccacggcatcacggccggggatgtacagcgggacgtggaggatgttctaaagcatgttttgggcgacagccctgcaaaataaagagagaagagaggaaacagtatgagaaaaaaacgtttagtcagcatgatgctggccgcagccatgacagccgggctgctggcaggctgtggttccggcgctaagtccgattccggttccgctgccgggggaaataccaccgcagcggcggaaggaggatcggcggcggaaggaggacaggccgcggaggatgagaaaattgagctcaccttcttttatcccatcggcgtgggcggggctttggcaacgctgatcgagaacctggcgacggaatttaccaaggagaatcccaacatcgtgttaaaccctgtatttgcggggaattccacggagaccatgaccaagacggtatccgcccttcagggaggcacgccgccggatttcgccatcctgccaaatccggagctttactctctgctggacatggacgcggtgatcccgttagacgactttatcgccaaggacggcggtcaggagtacatcgacgacttcatccccgcctttatgaagaattcctattatgacggaaagacctactccattcccttccagagaagcacgatcattatgtactacaataaggatcagtttaaggaagcgggtctggacccggagaagcccccgacgaactgggatgagctgcgggagtacgcgaagaagctgaccgtgaccgacgcctccggcaatgtttcccggtggggcgtgatgattcccatggacgatccctttatgttctacggcttctgccgccagaacagcagcgacccgcagtcccagatcatggcggaggacggcaagagcgtatacttcgacacgccggagaacgccgaggccctgcagtacctggttgatctggcgcaggtggacaaggtgatgcccgagggctccatcaagtggggagacggtccgtccaactttatggcaggggcaacctccatcaccttcacttccagcggaagcctgaccaacattctggacaacacggacttcgaggtgggaaccgcgttcctgcccgcaggcaagcagtacggttcagccaccggcggcgcgaacctgtatattttcaaggatatcgacgagaagaagcaggaagcggcctggaagttcatccgctggatcaccgagccggagcgcgcggcgcagtggagcattgacaccggctacgtggccacccgcaagagttcctacgacaccgaccggatgaaagactacctggctaaggtgcctcaggcagccaccgcaaaggaccagctggactacgcgtgcagcgagctgcgcgtgcacaacaaccagcgcgtcctgcaggccttaaagcagggagttgacgccgccatgaccggggctatgacgcctgaggaggccatgaagcaggcgcaggcagaggcggaagcgcttctggaatcctaccagtaacacgagttcgaactcccggagggcccggcggcctgtccgggagttctcttaaaggccaggcgaaacgtatcaagaggtgaatgactgatgaaacagaaaatttccatgagaaccaaatggacggtacagggctggctgctcatgctgccgtcgttaatcttcctggtgggatttaccgtctaccccgtaatccgcaccctgatccaaagctttatgaaaaccagcaacaacgccaaggcgcctgcggaatttatcgggtttaaaaattacatcaacgtattccgggatcccgtgttcgccatcgtgatcaaaaacacgctgaaattctccctgatcgtgatcccgctggggctggtgatcggttttcttctggccaccctggtgagcaaaaatattaaggggatcggcgtggcaagagccctgatcttttatcccaacgtggcccccgtggtgggcttcgccaccatctggacctttctgttcacccccaatatcggcgtgatcagccatgtgatgaaggccctctccatgaagccggtggatttcctcaataatcccaagaccgccctgtacgccatcatggccgtttacctttggcgggaggccagctacatgatgattttctatatctccggccttcagaatatttctcaggagtattacgaggcggcgcatctggacggcgcttccgggtgggatatcatgcgcaagatcaccatcccgctggtgcagcccaccaccctgttcgtgctgaccatcaccatggcggacgccttcaagatggtggacctgatcatggtcatgaccaccaagggcggacccaacaacagcaccaacctgctgatgaatcacatctaccagaccgccttctcctactgggatacggggcaggcgtcggtgctgaccatctgcatgctgggctttatgatggtggtcgccctggtgcagttcaccaccatggacaagcgcgcgtactacgaaaattaaggaggcctctatgaaaacgaaaatgagccccatcaaatacatacttctggcggccctctgctttctctgggcgttcccgcttttgtgggccgtggtcacggcgttccggcccagcaacctggccaccggcttttcgctgacgcccagcttcacgctggacaacatccgcgaggtgttcggcgcggcgccctttgtgaaatacggtctgaacacggtaatcatcgtgttcggtatcctgggagtccagctggtcaccgtcaccctgggagcctacgccctggcgcgggtggatttcgccgggaagggcctggcaatggccctgatcatgatgcagattatcatccccgccgatatcctgattctgcccaactaccagaccttgaaggccgtgaatttaatcgactcccggctgggcgtcatggtgccctatttcgcctcctccatgggtctgctgctgttgcgccaagcgttcaagagcgtgccctccgccatcgtggatgcggcccgcatggacggtgccacagtgcttcagaccctgcgctacattttcattccgtgcagcaaggcggcttacatttcctttgccatctgctccatcagcacccactggaacaacttcctctggcccatgatcgtgatcaactcgccggagaagcgccctctgaccatgggtctggtccttttcgccaaggccaacgattccggccccatgtgggccctggtgacctcggccaccctgctggtcatgttcccgctgttcgtcatgttctgcgttttccagaagcagttcgtgtccagcttcgtgacatcgggaattaaatagaatattggaaaattaagggaaatccgggattttattcccggattttttcgtgaatggaacggaccgccggggcaggggctccgggagggcttgttttttcccgctgtaacagaatttcccactatttctcatgaaaaaagtaaggaaaatcacagcatcttgtgatagaatgttaattaatgtgaatataacatttaacataagaggaggagcgacatgcccgatattaacattctggtagttgacgacgagaaagaaatcgcggatctgattgaaatctatctggtgagcgatggctataaagtattcaaggctgagaacgcggccagaggcctggagattctggagaaggaggagatccacctggtgctgcttgacatcatgatgcccggtatgaacggcctcgagatgtgcaagaagatccgggagaacaacaacatcccgattatcatgctcagcgccaagtccacggacttagataagattctgggcctgggaaccggggccgacgactatgtggtgaagcccttcaatcccctggagctgaccgcccgggtgaagtcccagctgcgccgctacacccagttgaaccccaacagcggttccagagagcaggccaacaacgagatcaccatcaagggcatggtgatcaacaaggacaaccacaaggtgatcgtggacgacgaggagatcaagctcacccccatcgagttcgacattctctatctcctggcctccaaccccggcagggtgttcagcacggacgagatcttcgagaaggtttggaacgagaaggtctatgaggccaacaataccgttatggtacatatcagaaggctgagaggcaagctgaaggaggacaccagacagagcaaaatcattacgacagtgtggggagtagggtacaaaattgaaaagtgatatgagcaggcgttaccacacccgtgtggtgaccaatatcgtttacagcgcgattatcacctgtctggtggaagtgttcgtggtggcgaacatgacgatgatcgcccgctatatggaagacgccgggaagctgaaccgcctggcggagctgctcctttccatgaacgcggcggtggtgctggtctacgtggtgagcggaatcctgctcttctccgtgaccttcctgcttttgcaggagtcctccatccgctacatcagccacatctcggatgccattcagaacatttccgagggggatttgaacaccaccatcgacgtgatcggggacgacgagttctccagtatggcggccaatttaaacaagatggccgaggacatccgccagctgatggaaaaggagcgggagagcgagcgcaccaagaatgagctgatcaccaatgtggcccacgacctgagaaccccgctgacgtccattatcggatatctggagctgctggccggcaataccaggatcgatccggagatgcagcacaaatacatagagatcgcctacggcaagtccaaacgcctggagaagctgatcgaggacctgttcggctttaccaagctcaattacggcaagatgtccatgcacgtggcccagctggatcttgtgaaactcctgggacagcttctggaggaggcttaccccaactttgcggagaagaacctgtcctacgacttacagagcaacgttccggcgaagatgatttccgcggacggcaatctgttagccaggctgttcgacaacctgatcggaaacgccatcaagtacggcgcggacggcaagcgggtgctggtgcagatctttgccggcgaggaagtggtgacggtctctgtgacaaactacgggtatgtgatcccgccggatgagctgccgctcatcttcaacaagttttaccgcgtggagcggtccagatccagcagcaccggaggcacggggctggggcttgccattgccaaggagatcgtggacatgcacggcggaaccatcggcgtgaccagcgatctgaacggaaccgtgttcacggtgaagctgcaggtgcattttgatgtaaataaagagaattttgggacgattagctgattgttgctccggggatgcgaggaagcgtcccggacgcattcagctaatcgcgttatgggagaacagaaaatgatgggaagatttcggatattgccgcagggaagacgcatccgggccgctgtgattctggttggcctgcttttgtgcatcctggccgcggttccggctgcggcgcagaccgccggggcagcggagggcctggacggagggcagcttaaactggatgtggtttacggatatcagggaaccgccaagagcgggcgttacctccccttaaaaatccgcattgaaaacccgggcggcgctccattttcgggaacgctctccgtgctgaccatggaatcggactatgagctgtaccgctatgagtatccgttgaacctggaggccggggagagctttgccaaggacatgagtatttccctgggcgcccgcatcgaccagatgtatgtgaaggttatggaccaggagggccgggagattgccagcaagcgcctgaagctgaacgtgagcatggagaccgcggagctgtttgtgggcattttgagcgacacgccggaccgccttcaatatttaaatggcgtgggcgtcaactacagcaccctgcgcacccggaccattgaaatgtccgcgcggaccctgccctcccaggagatggagctggatcagctggatgtgctgctgatctccaattttgacaccggcaccctgagcggcgaccaggtgaaggcggtgtgggagtgggtgtccaagggcggcgtgctgcttcttggaaccggagagcgggcggaggacgtgatgcgggccttcggcgacgatttgctgctggctcccctgcccctggcggatctgcaggagatcaatatgggagtggagtttgccaaggacagcccaaagggagcgaccattcccctggaatgcacggacgtctacatgctgggggccagcgaggtgctctccagcgacgagctgtcggtgctgacctccgtcaccgtggacaacgggctggtgggcgcggccatctatgatttcgtggatattgaggcattctgccaggaaaatgtctcctatgtggacaatttattctcctcccttctgggggaggaccggatcaactatttagtcagctcctcggacggcaccaactccagccagtactggtcggtccagagcctgatcaacacgggagatatcaaccggctgcccaaggtgggactttacaccatggcggcgctggcctatgtggccctggtgggcccgggcctgtatttcttcttaaagcagcgggggatgcgaaggtactatccacgggcggtgattctgctggccctgtgttgtacgggtatggtgtatttcatgggccttaccacccggtttaacggtccgtttttcacctacgccaccatcaaggacatggatgaggacaacgtagtggagaccacctttatcaatatgcaggccccgtacaacaagccctactccgtggagctggacccgtcgtacatggtgcagcccattacccgcagcgcctactacgacgcgtactatggaaatatgcaggtgcccaaattcaccggcaccgaggagccggacgtgaacctgcggttcgacgagtccgcaacccgggtcagcgccaggaatgtgggggcctttgtcccgctgtatttccagatggagcgtaagaccgagaataccagcaaggcgggatttaccggggagatccattgttttgacgggacggtctccgggaccctgaccaacggctacaatcacccggtggacgacgtggcggttctgatgtacaatcagatggtgatggtgggccatatggaggcgggcgagacggtggagctggacaaccgcgaggtggtgtacggcgtcatgaacttcggttatcccatggcggagcagatcaccggcgcttcccggtaccgggagggggatttaaatgacgccgagtacgtgcacgctctggaacgcaccaacctgctgaccttctacattggaaattatctgaccggctaccactccgaggcgcgtgtggtgggcttcagccagaaccagcagggcggcggatttttggcaaagaagggatacgagacctacggttccacgctgatcacctcctcggtgaaggtggattatgagcaggacggactggtttaccgctccgggctgcagaagaatcccaacgtgctcagcggcgagtattacgccaggagcaacaccatgtacggcgtgacgcctctgattctggagtattacctgggcaacgacaccgaggtggagcgggtggatttccaccagctgtccgacaaggtgatccagagcctgcgttacaattatacggttccctttgtgggaaatatctacttctacaactatgataccggcaattacgaccccatggacatcggcgtggaggaattcggccgggaggcgctggagccgtatctgtccccgggcaacacgctgacggtgaaatacgtgtacacgaacccggaggattacagctggaacattatactgcccattctgacggtgatagggaggaacaagtgatgctggaaatcagggatctgcacaaggtttacggaaaataccatgccctgaacggtttaaatatgacggtccgtgacggcgctctgtacggattcgtgggccccaacggcgcgggaaagaccaccaccatcaagatcatggccgggcttttgggcgcggacggcgggagcgtgatgatcggcggggaggacggcctcgcctccccggccaggcttaagaaaatgatcgggtatgtgccggatttcttcggcgtttacgacaatctgaccgtatccgagtatatggaattttttgcctcctgctacaacatagacgggctggtggcgcgcaagcggtatacggccctgctggagcaggtggggctggaggaccggctggatttctatgtggacggactttcccggggaatgaagcagcggctgtgcctggcccgggcgctgatccacgatccggaaatcctcattctcgacgagcccacctcgggcctggatcccaggacgcggttcgaattcaaggagattttaaaagatttacaggagtccgggcggacgattttcatcagctcccatgtgctctccgagctgtcggagctctgcacggacatcggtatactggaccagggaaggctggtgctggagggcaatatccaggacattttggcccgggtgaacgcctccaaccccctggtgatttcggtttacagcaaccgggaacaggcgttaagcgtgctcaaaagccacccctgcgtgcagaccatttccctgcgggaaaatgaaatctgcgtccggtttatgggcgataagcaggacgaggccatgctgctgcagcagctggtcgacgcggaggtgctggtcaacggctttgtccgcgagacaggaagcctggaatccgtctttatgcagctgacggagcgggaggaagagaggtcggtgttatcctatgaagcagaatccggtttataagcgggaatcccgggtgaattcccgaagcctgcgcctgccgctgatcctgacggtgtttaacggcatcctctgcgcggtggcgctgatgaatatgtattcggtggtctcccaggtcaaggccacggccaccatccagtacagcagctttatggaaatgtacgagtttgtggccaccattgagtttattcttctgaccttcatcgtgccggcggtgacggcctccagcatcagcggggagcgggagcgccagactttggagctcatgctgaccactcagatgacgccctcgcagattgtgagcgggaagctgatgagcgccctcagtacgctgctgctgttgattatctccagctttccggcgattatgatggtgtttgtgttcggcgggatcaccggaacggacgtggtggccctgcttctgtgttatacggcggtggcgctgtttgcggggagccttggaatctgcttttcctcggctttcaagcgctccacactgtccaccgtgctgacctacggggtgctggtgagcattgtggggggaacctactttgtcaaccggtttgtgctggggctttccgccggcaggatcaacagctacgccatcacctatggcatcggcagggcgcagcagcagcccacgtccgggaattttgtctacctgctgctgatgaatccggcggccacattttacgcaattatcagcgggcaggcgggcagcggaagcggcgtcgacaagctgtgccaggctttcggaatcgttcagaagggctgggtgatggaaaactgggtgctgatcagcatcgtgctgcagctggcggtggccggctgcctgctgacgttagcgatatggtttgtgaatccgatccggcgcaggcggaaaaaccgcggctgagcgggaagcacagtgtgaaaacgattattcagaaaggggaatatagattatgggaattatcaagtcagtaaagtcggcgattgggggagcctttggcgaccagtggctggaggtcgtggagcccgatgacatgggcggccagaccgtgtttgtgcggggcgtgcaggtgagacaggggcgcggctccaatgtaaagggaagcagcgacaccgtgaccaacggctccgtgatccacgtgtatcccaatcagtttatgatgctggtggacggcggtaaggtggtggactacaccgcggaggagggctactacacggtgaacaactcgtccctgccctccctgtttaacgggcagttcggggattctctgaccgagtccttcaaccgcgtgcgctacgggggcatcacgcccggcgttcagaaggtgttttatgtgaaccttcaggagatcaagggcatcaagttcggcacccgcaatccggtgaactattttgacaatttttacaacgcggagttgtttttgcgggcccacggcacctactccatcaaggtgacggatcccctcaagttctatgctgaggtcattcccaaaaacgcggaccgggtggagatcgagagcatcaattcccaatacctgtccgagttcctggaggctttgcagacctccatcaaccagatggctgcggacggcaccagaatttcctttgtgacctccaagagccgggagctgggccgctatatgtccgacaccctggacgaggagtggaacaagctgcgcggtatggagattcaggcggtgggaatcgcaagtatctcctacgacgaggagtcccagaagctgatcaacctgcgcaacaagggcgccatgatgggcgatcccctggtgcgcgagggttatgtgcagagcaccatcgccgagggcttaaagaacgccggtggaaacgcgaacggcgcgctggcgggctttatgggcatggggatgggaatgcagtcctccggcagcttcatgggggcggcttccaataccaacatggcccagatgcagatgaaccagatgcccggcggacagtggcagggcgcggccgggatgccttatgggcaggggatgccgggagcggctggagcggccgggatgccgtacgggcaggggatgccgggagcggctgggagcgcagggatgccgggagcggctggggctgggatggccggagcggccggagccgggatggccggagcggctggagccgggatgccgggagcggccggagcgccggaggcggaacagggacagccggtgtccggccaggccggaactcaggcggagtctcatcccgcgggatggatctgcccgcgctgccagaatgaaaatcacggcaagttttgcagcgagtgcggcagcccgcgcccggtgagcgagtcctgggtttgcagctgcggtacccagaacacaggaaaattctgcagcgagtgcggaaagcccaggccataacagacacagggggacaattcgatcatggcgacaattacctataaatgcccgaactgcgacggcgggctgctgtttgacccgtccacccagaaatatcactgcgaatactgtcagtccagcttctcccaggaggagctggacgccctggctcccgcggcggcatcggatacggctgtgccgacggggatggaggctgagggggtgttgggcggagaagcggcaggcgggagcgccggggccggaggagccgccccccaaaccgcggaggcattttccgacgaaactgcccgtgaaccggaggcggcttcggacggttatgcgcaggatgcggcttaccagggcgatgcgatgctctacacctgccccagctgcggcgcggagatcgtgacggacgctacaacggcggccaccttctgttattactgccacaacccggtggtgctgtccggcaggctgacgggcacctatcagccggattttgcgatccccttccaaatcgatcggaagcgggcgcaggaggtattttcccagtggattgcgaaaaagaagttcgtgcccagggagttttactcccccaagcagattgaaaccatgaccggcgtgtatttcccttactggctgttcagctgcaaggtagacgggtcggtgcagggacaggggaccaagctgcgggtctggacggcgggaaatctgcgttatacggaaactaaaatttacgacatcgcccgtcagggtacggtggaagtgaatcatgtggcgcgcaatgccttaaaaaaagcaaaccgccgtctggtggacggggtccagccctttgagatgggggagatgcagcggttttccatgggttatctctccggctttatggctgagaaccgggatatggagcggaatttctttgagacggaggtatcccaggaggtgcgggatttcgcggtttccgggctgaagagccagggaatctcctacgaccggatccagatcaccaaccagagggcggaaatctcagacggtttctggcagtacgcgctgctgccggtatggacgctcacctacaaggagcgccagggcggcaaaatttattattttgccatgaacggccagaccggaaaggtctgcggcgagctgccggtggacaaagggaagctgctgattctgttttcctccatcttcctgccgctgctgatcattctactgattttggggtacataatatgacagggataaacaggacgaaaaatggcaaaataaaaaggcgccttctttcctgggcggctctgatgatgtgcgctgtgctggcgcttctggctgcgccggtgctgccggtggcggcggccggaccggcggtagtttacggagcggaaaaaaagattgcagaagaggttcccgtggagcgtatattcgacggcgcggggctgttcgacgcaaaggaacgggctcatctggaagagatggcggccagctaccgggatgagatgggcgttgacctggtggtggtgacggccttcaacgacggcaggcataccgcgatggaatatgccgacgatttttacgattacggcggttttggggagggaaaggatgcggacggcgttctgtttctgatttatctggaccggccgggctctgtcaccggggattactggatttccaccaccggagtcatgatccggattctcacggacaagcgcatcgataccatgaaggccaatgtggtgggctttctcaaggatcaggactatgcgggagcggcacagcagtttatgcgcgacgtgtcctattacgtggataagggcattgtgtcagggcagtacaattatgactcggaaaccggcaggatcagccgctaccacagtatccgctggtacgaggcgctctttgccgtagcggtggccgccggcgtagcgctctcggcctgtctgggcgtgatgcaccggtattccatgaagcccagccgccgccagaaggagaacggtctgatggcctaccgggcgggcgccaatttctgtatgaacaatatacaggacattctggtcaagcagtttaccacccacacgcggatttccacctcatccggtggcagagcgggcggaggcggccgcagcaccactcacacctccagcagcggcaggagccacggaggcggaggcggcaggttttaaggcgcccgcccgtcccgccaaacgtttaaaaaatggtaaatgcgcgcctcatgcacattttccgggatttatgatatactatattagagactgcagtcggcatcatcaaatggtaatgcggtgcgcatccagctggtgctttaaatagattacggggcgctttatctccgggcggcgatgacaggttatggatgtcgttgccgtttacatagcacgccaccgcagcacgggattagattaacagaatatggaagaaaagagcaactacacctatatcttgacatgtgcggacggaacgctctactgcggttggacaaaccatctggagcagagggtgaaagcccataatgaaggccggggcgccaagtataccaaggcgcgccggcccgttgtgttatcctactgggaagcctttgacaccaaggaggaagcgatgcgcagggagtatgcgatcaagcggctgagacggggggagaagctgcggttgattgaggcccgaggcctgagcgccggacggaacgggaaaatataaaaatagtcatgataaagacagctgccggtgggcggctgtcttttgttgaatgcggcgtgcgccccaggccgccgtttaccaggtgtgcaggcttccatcaccctggcggcagatagggatatacgccttacggaacggataccgggctgccgctgcctcgtccacatcgcagccaattcccggacggtcctccatgaacagggagccattttcatataccggaccgccggacaccacctcgtggattaatccgtccgtggttccatcctcctggataccgaagttgtactcggacacattcagatgccagttcacggcgtgagtgatgggagagacgtcgttggggccgtgccaggctgttttgatatcataggtttcggccagtgaggcgattttccgggcctcggtgatgccgccaacgcggatcacgtcgcagcggatataatccacccaatggcccgtgatagcgggcaggcattcccagcggcttttgtaaagttcgccgaaggcgatcggcacggaggttttttcccgcacatagcgcaggctgtccacgcagtccggagcaatggggtcctcgatgaagaacgggttgtagagctccaggctccgcataatccgtatggcctggtccgggctgaagcgctcgtggagatcatagatgatgcccacatcccgccccacggcctcccgaacccggatgaaatattcgatggagttgtagatttcctcctccgggttccacggctccaccagggggccgttctgaggggacttgaccccaaaggtgcccgccgccgcggggatgcccgccctcaggcggattaccttcagctgacgctgtttcacatagtctgcggcccgggcgattttgtcttccatggtcttaccaagaatgtgggagtagcacaatacgctgttgcgcatcttaccgcccagcagggcatacaatggcttgcccgaggttttccccagaatatcccacagcgccatgtcgattccgcacagcgcgctcatcataatattcccgccccgccagtaggtgcctcggtaggcgagctgccagaaatcctcgatctggccgggatccctcccgatcagcaggggagtcagataggcgtcgatcaggtcggctaccgcctgttcccggccgtttagggaggcgtcccccactccgtagacaccggaatccgtgatgattttcacaaaaagataattctggttgggagaggtaaggattgttgttacctgtattattttcatatgtcaaatcctttggttttagagtgttggtgttgtggaaagagaaatggctggttcctccataaaccaatcctaacggaaaaatagcgtttcgtaaatcaaaaatgcaaattattgcaatagattctattttatatcgattatatttgcaaaaatttcgaattttcttgtggcaatatggctggaacgctataatggactcatatgaaaggagaacggagttatggaagagatcagaagagatgatgaatttggggaggatatcgaatacataggcaggatcaagatgcagtacgcctccctgtccaaatcccagaagcgtatcgctaattatattttaaatcaccgggaggctgtgatccaccactcgatcaccaccatggctcagaaaaccggcaccgtgccctccacggtgacccggttctgtcaggccctctcctataaagggttcagcgagatgaaggtctatatggagaaaaacctggcctccccgctgacgatggatgctctgatccagaaaacggacacgcttcaggtagttttacagaaactgatgaatagctcccaaaacgccattcaggataccatgcggaccttggatgcccgcagtctgacggaggcggtggatgccatcctggcggcggggaatattctgctgtttggtcagagcggcgggtatatctccgccacctacgccaggcagctgctattgcgcatcaatgttctcagccaggcggtgaacgaccgggtggatgcaaacctggcggccagcacgctgaagaagggcgacgtggccatcggctttgcctacagcggggaagccagatccgtgatcgaagcattgactacggccaagcacaacaaggccacaaccattgttatcaccgccaacacaaactccaccatggcaaagctggcggacctgaagctgttttacagttataatattcccgacgatctccagtacctgcacttggccagcatgtgtgagatcatgatcatcggcgccatccaggcggagattttgagacgtcccatgcagctggagaaaatagatgcatgtaaaaaggcggtgctggccagcagggtgaaatagcgcgggagtagaccgaaatcgaaaaatttgcaaaaatgtatgcgtaaaagtaaaaacgattgcaacaatttgcattttctgtttacttgcgctgttttttgatgtattttataaaaagagcatattttagcattattatttgttcaattctccaagaaatggaacgaaaaatggctggggcacataatttgctgaaataaacccgctcagatatctgaaaatgaatgggaggtttacagtccgaatggaggagactatgaatcaggagctgatcgagatcaagagctgtggggaaccaggctatcatcctctggtgtattttggcggatggcgcgtggcatttttaaatgacactgccaggttccacctggaacggatcagggagatgcagcggcacaacacgtcggacgaggtgtttctgctgatacagggctcctgcacgctgtatgtggcggcggcattggagtccggaatcggggagattactgcggtggaactggagccgggcaggatgtacaatgtccggaaaggtgtctggcatacgcatgtcaccggacctggagctaaaatcgctatcattgaggatgcggacgtctcaccggacaattcggagttgatctctgtggatccgcgggccttgtacgaggcccaaaatcgcgaaaacggcggcggtgcggggaatgcgcttccgacccaaaacggcgaatgacaaaacaggaggagaaaacatgaaacgaaatttaaatttagcattggtatccatattggctctctgtctggcggcaggttgttccagaacgaatgagaaacaggagacgactgcgctggctgctgcccagactccaacggaaagcgctgcggaaggcgagagcggggggttgaagctctccggccgtcactggaagatcggcggtcaggtgcgccagaccagtctttatctctattatgcccgggacttgggcctgtttgaggaggcgggactggacgtggagatcgtgacactggccaacggtccggctttgaatgaagcgctgaacgcgggggagatcgacgcggcggccaacggcatggcggcggtatacgtccttcccacggaaaacttttactatgtgggagacgccaccatcaactttggcggtcagtccctttatgcccgcacggacagcgaagttgtaaaggcaggagtctatcaggatacaggctattacggcagcccggagaccgtgaaagggacaacgatcctgggcctgggggcaggaccgcagcagtacatcgcctttgcctatgcggaggccatgggcctgtctgcagatgagattgaatttgtagccatggaccacgcccaggcctatgaggcctttattacgggccagggagacctgctgggaaccacgccgccttactcgaacactctggagagcgatcccgcctataccctggtggcggactatacggacctggcgggcggcccgctggtggactcctttattgtggggaaagagctggccgaccagtatcccgatgatgtggtggcgattctgaactgcgtctatgaagcaatggaccggctggctacggacgacggagcccgcggggagtatgccatgaagctgtacaaggacgaaggcggtaccaattactctgaggaggatatggcatccgagatcaaaaacgtgacgttctggacatgggagaatttggaaaatcctgcttacccttacggaaataccatgaaggtgatgggcaacttcctgatgacccagggactgattgaggacgatgccatgccgagaatcgaggcggcgttgaatcacagctttatcgaccggttgttggagtatcgtgccggactggagaaataattccgggacaaccgcaaattctggatagaaagtgttgatcaaatgaaaaaactgatagagcaatacaagtatattttaatctcctgcgcctcggtggccgtggtgctcctggtctggtatatcgccatcgatgtgatgaagctggccaagagctccgttttcccgggactggagaagaccgtggacacgtttctcacgaagctggtggaaaaaaagccggatggcgccaccctggggcagcatctcctggagagcctgaaggtctgcctgatggggtatagcatcggggcgcttttgggagtgcctctggggatcgccatggcctggaacaagtggtgcgactggctggtccgcccggtattcgacctgatccggccggtaccgggcctggcctggacacctatgtttatcctgattttcgggatcggaatcgaagctaaagcaatggtaatatttgttaattcttttgtggcctgtattgtgaacacttatacgggaatccgacagaccgaccagctgcatctgtgggtgggggatgtgttcggatccagtcagtggcagaagctggtcaagatcgcgatccccaccgccacgcccatgattttcaccggactgcggaccgcgctgggcggaagctggatggcgctggtggcagcagagatgctggcggccagcaaggggttgggattcatgatccagcaggcccgttacatctcccgcccggatctggtgatcgtgggcatgctgatgatcggcgtggtcgggctggcgctggatgcgattctgcaaaagattgagacaatggtcgcgaagggaatgaatgcgcaatgaaaaagaaacgctttaatacgatggaactgttctgtgcggccatatcgatcggtgcgtttttatgcctgtggaattttggcgtgacgggggatttgggaaggctgatgccaggccccatccccgtcctccgcaagttttttgaaaccctgttcggcggacggatcggttcgaaaacattgataatgcatgttgtatacagccttttgcgcgtgatggcgggctacttcattggggcggccgtcggcgtggtgctggggcttagtatgggctggagccggttggttgaggcggttttttcaccggtctttcggatcatccgccccattccgcccatcgcctggatccccatctccattgtgtggatcggcctgggggagggagcgaaggtatttctgatttttctggcttccttttgttatgtcacgctcaatgcgtggagcggggcgaaaaatgtaaatccggagtacatcgatgcggcccggatgctgggggcaggcaagcgtaagattctttttacagtggttctgcctgccacgattccacccattttcgccggcctgcaggtggcgttgtccagctgctgggcgacggtgcttgccgctgagatggtgcgctcctccgaggggctgggatggattatcattgccgggatgaacaacaatgatatgatccagattatgacgggaattctggccatcggcattgttggcatgctgctttccactatattcagaaaggttgaggcgagattatgtcgatggaacagaagcgagggctgattgaatgccaggggatttgtaaaacattcaaggtcccgtcgggggaacaccaagtagtggcggactttgacctgacggcggacgagaacgagtttatctgcctgttcgggccgggacagtgcggcaagaccacgctgatcaatctgatcgccggttttgagccgcccacatcgggcacgatcacggtggccggtcaaccggttaccgggccggggccggatcggggcgtggtgtttcagaacatcaccctgtttccctggctgactgcaattaaaaacgtggagtatggcctgaaaatggccggggttgctccgaaggagaggcgcaggcgcgcccagaaatatatggacctggtgggattgcagggatttgaggactcctttcccgtgcagctgtccggcggtatgaagcagcgcgttggaatcgcccgcgcatattgcattgagccccgggtgatgctgatggatgagcctttcggcgcgttggatgcccagacccggtatctgatgcaggaggaattgcagcgcatctggcagacggagaaacggacgattatttttgtaaccaacaatattgaggaggcgatctacctggcggaccggatcgtggtgttgtccaactgcccggccacggtcaaaaaggagtatgtgatcgacctgccccgcccacggaaatatacgtcctccgaatttttggcgctgcgcaaggaaattaccggcatcgtggacaagacattgtgaggagggcgttaacatgagagaacaagagagcggcagcagccggaccaaagtgcaggtcaggcatctgactaagaaatttggcgacttgctggtgctggacgacatatccttcgatgtggaaaagggggatctgctgtgcgttgtaggcccgacaggctgcgggaagaccacctttttaaacagcctgaccaggatctatgacatcacctccggcgaaatattgctggacgggcatccggttgaccctaaaaaggacaatattgcctatattttccagggaaattctactatgccatggctgacggtggagcagaatgtggcctttggcctggacatcaagcatacgccccagaaaaagcgccaggagctggtggagaaatatctggacattgtgggacttacaaaatatcgcagctattacccaaaacagctttccgccagcatgctgcagcgcgtatccattgccagggcttttgccacggagccggagctgctgctcatggacgaaccctacgggcagttggatattgaactgcgcttcaagctggaggacgagttgatccggctgtggcagatgaccgggaccacggttctgtttatcactcacaacatcgaggaagccgtgtatttgggcgaacacattatgatcctgaccaataagccgaccacagtcaaacagacgctggagaaccatctgccgcggccgcgggacatcgccgctccagagttcgtacagctgcgcgaacaggtgaccgagctcatcaaatggtggtgattcgatgaatatgagaacgtatgagaaactatttcaggaccgggattatccggtgctgatcacgacacaacagaatattttttacacggttggtttttccactaccgccaggagaccgtcgcagatcggttataactgcgtcctgctggcgccggacggcgcttggttcttctttccggccgggtggcagccgctggttcaggaacagctttacgcggagccggtgaccctggtgccttaccagggatccgtggagcagatggcggagagaattgtccagcgccttggaaatgcaaaatgcctgggatttgagcaggacgggatggagttgaatctctatttgacactgcggcgtttgctgaaggagacgggccgttctctctgctggacggatgtgtccactcatttgcagcgggccaggctgatcaaatcacccgaagagattcaggcgctgagggactcggcacaggtggcgaaggaggccatggagtacgccaagagcctggtccggcctgggctgcgggagcgggacgtggtggcggagctggaatattttatgcgcaggctgggatcggagggcgtgccctttaccatgaaggccctggctggggagaacgcgctcaggaccatcaacctgccaggggattaccggatacaagagggggatgtggtcctgctggactttggggcggtagtgaatcactatgcctccgactggacgagaagctttgccgtgggctacgcgggggaggagcagagggagctttaccagctggtctggcacatcgaacgggcctgtattcagatgatccggcccggcgttcgttttcagcagctgatggatcaggccatgaaggtgattcacggacacccctatgccagatggtttaatccgtatctgggacacagcatcggcatcaacagccaggaatggccggccattgtgccgggggcggaggacgtgctcagggagaatatggtggtgaccatcgagccgggagtatatgtgccaggggtgggcggcgtgcgcattgaggacgaggttctggtgacggcaaatggttatgagattctcaccggcctgcgggatgaggagtttgtgattggaggcgcgggttatggagaagaatagggggaaatgcggatggtagtgacgaactggcgggacgccgcgcccaccattgtccatgactttggcatcgattacaaactgctgaaggggcaggaggcgtacgatcccggcattcccaactgctgcatgaggggcatgctctacgtggcctacgccatgctgcaggagggcaaggcgtacgaggctcacgcccacggggatcacgaggaggtttactatatcatttccggcataggggagatgacggtgaacggagagacccgcgccatacgggacggggatgcggtgtttataccagcgggatttacccattccatcgccaaccggggccagggatttctggtgtttctggcattttcttcccaggtcccggaccgggcagcaggagcagagggaatataatcagaaggaggagattgggatggagagaagaaaagcagtggtaaccggaggcagcagcggcatcggccggggagttgtgtactgcctggcggccgatggctgcgacgtggtattttcctaccggagcaaggcggaaaatgccagaaaggtgctggaggacctgcagggtcgatatccggaagggaaattcacctgttttgagggcgatttctcagaggacggagcgggcgtggcattttttaaccaggcggtggaatttctgggagggctggatctgatggtcaacaacgcaggcgtgaccatactggagagtatttttgatctgacggaagaacatatggattatttgattcaggttctgttccgcaactacgtgattctcatgcgggagtctgccacctatatggcggctcacggtataaagggaagcattatcaacattagctctgtgcgtgggctgagcgcccatcccggagatctggtctatggtgggatcaaggcggcgctaaaccgcgcatgtcagtccgtcgccctggacgtggcgccctatggaatccgggtgaacaacattctgccgggggccacgcgccggtttacaccggaggaggagcagtctgcagacccggctcacattgagaagattaaatttctgtcccgccggattccgctggagcggtatgggacgccggaggatatagggaacgcggtagtgtttctgtcctcggagaaggcctcgtacattacgggaatctccctggtgatcgacgggggtctgtcccttcccggcctggctgaaaccgcctgggaggcggaaagcggctggggaaaggtcaagcgggaggtggactggaagccgcggggatgacaggcaggcccgcggagaaataaacggagatcggctcccctcttgccgaggagcgctgttcaaaatataaaggcccggaaaacgtatgatgtcccaacgttttccgggccttttccgagacgtgcggccgggatgtctcctcaatccgctatccgtattttctccatgcccctggatttccccagccgcccatggtatgataatgcgtgtattgttttacgccacaaaccggtacatcagcacatagtggcacaggcttccgcccatgacgaacagatggaagatctcgtgagagccgaaatacttgtgtttggagttgaagaacggcagcttcagggcgtagatgatgccgcccacggtgtagatgatgccgcccgccaggagccaggcaaagccggctctggacagggagctgacgatcttggtgaacgccaggatgcatacccagcccatggcgatgtaaatcagggaagagaaccacttggggcaggtgatccagcaggcgttgatgatgatacccacgatggcgatagcccagaccagacccagcaggatccagccggtcttgtcgcccagcacaatcatgcacaccggagtgtaggtgccggcgatgagaatgaagatcatcatgtggtccagtttgcgcagaagctggttgactttcggggaaatatccaggctgtgatagatcgtgctggcggcgtaaaggccgatcatactcaggataaagattgtgagcgagataaaatgcagatggtccggttcccgggccgctttcagcagcaggggagcggtggcgcagatggctaacaccatggcgataaaatgggtgatcgcgctgcccgggtccttgatccggcttacgccctgtttgatgtgtgtcttcataaaaatcaacctccctgtcttaatgtcaattctctgttgccagaggatgaattatcaataactttgatatgtagtaatgaaaactatgttgccttatattttatactatacaccagccgggaaaattatgcaatacttttgaaaaaatacttttataatcaaagtattttagacggcagttcagacggcgggaagattggtgttgtaaggcgcgtcgagtgtgcttgtaagcacccttcggaaccaattttcacaccgtttggacatccgaggcagcctgaccggtgtttccggtcagaaagacagactgccagagtgtttaggaatatttgtaccggagcgaaggaggagcgatgattaccgtattatatgaagattctgatgtgattgttgtggagaaaccggcgggagtggaatcccagtccgcccggggctttgagccggatatggtgagccgcatccgcacacatatccacaagttatcaccaaacccttccccaaaatccacaaaccatccaccatatgtgggagttatccacagactggacaagccggtccggggggtgatggtctacgccaaaaatcaaaaatctgccgcaaacttaagtgcacagattcaagagagaaaaatgcggaaaatttatgccgccgtggtttgtggaaaacctgtggataaccagggggtctatgtggattatctgttgaaaaatcagggaaacagcggttctgagattgtggataactctgtggacggcgcgaagcgggcggagcttatataccgggttttggaaacggtaaaagcggggagatggatggcggaaaatccggaaatggagctgtctctgctggatattgagttgatgaccggccgctaccaccagatacgggttcagatggccggacatggaacgccactgtttggggataaccggtatgggaattgtctgggcggtggaaaacgtgcgggagaaagtggatttagcgggcccaggcagccgttagccctgtgcgcaaggaagctgaccttttaccatccgtccaccggccgggagatcacctgtgagataaagccctcaggcggggccttcgggctttttggtcagaatttatttgaataaaagtggttatgaaaggcgcagagcccattcgcggcaatcccacaccgtggtggccagaccgctgtagaactccggctcatggcagatgagcagaatgctgcccttgtattccttcaaagcgcgctttaattcctccttggccaccacgtccagatggttggtgggctcgtccaggagaagcacgttggtttcccggttgatcagcttgcacaggcgtaccttggcctgttcgccgccgctgagcacccgcacctggctttcgatgtgatccgtggtcagcccgcatttggccagggcggagcgcacctggtactgggtgtaggcggggaattccttccagatttcctcgatgcaggtggtggtgttgccgggggccatttcctgctcaaagtagccgatggacaggtagtcgcccagctccacgctgccgcttaaggaggggatcaggcccaggatgctctttaacagggtggtttttccaattccgttggcaccggagagaaccaccttttccccgcgctgcatggtaaggtttaaaggccgggacaatggctcgtcgtagccgatcaccagatcctttgtctcaaagatcagctttccgggggtccgggaggtgagaaaatggaattccggcttgggtttttccctggccagctcgatcacttccatcttgtccagctttttctggcgggacatggccatgttgcgggtggacacccgggccttgttgcgggccacgaagtcctccagctcggcgatttcctgctgctggcgtttgtaggcggactccagctgagcctttttcaccgcgtagacctcttgaaacttgtcgtaatcccccacatagcggtccaggcgctggttctccatgtggtagatcaggttgatcacactgttgaggaaggggatgtcgtgggagatcaggatgaaggcgttctcgtattcctggaggtagcgcttcagccattcgatgtgctgcacgtccaggtagttggtgggctcgtccagcagcagaatgtccggcttctccagcagcagtttgcccagcagcaccttggtgcgctgtccgccgcttaaatccgtcacgtccttttccagaccgatctcattgagcccaagggcccgtgccacttcctccaccttggcgtcgattacatagaagtcgtgggccatcagcagatcctggatggtacccaactcctccatcatggcgttcatctcgtcctcgcccacctcccccatgcggtcgcaaatctggttcatctgctcttccatctcaaacaggaaggcgaaggcgctctttaacacgtcacggatggtcatgcccttctccagcaccgaatgctggtccaaatagcccacgcgcacccgcttggaccactccaccttgccctcgtcgggctgcagctttccggtgataatgttcatgaacgtggatttgccctccccgttggcccccacaaggccgatgtgctcgccctttaagagccggaaggacacgtcctggaaaatagcccggtccccgaagccgtggcttagatgctcgacatttaatatactcatgatgaagactcctttattgttgtcaaaacggtaatttcagcttgatttgaagcgattgaatgaatacagcagtattattctacatgagggagtatgttctgacaagcggaaatcgtattttttgcggaaatgtggggcatggaatggaaatattgcaacgggaccctgaaatttaaatttctcgattttcagtgaatgataaaaattcaaaatttttattttcatatattaagctaaaaggcctacgaatttctgctcgaatacaaaacataggtctggcatgaaataaacctactttttgtacgctttatcatataaatacgcgcgcgtgttcggaaaataaatggccaatcgtttcttccagcgataataagtatcgctggaaatttttaatttgcggatgatatcgttataggaaaggtctgtgttatagattagatggctaaaatgaatgaacttgttgaaatttgtcgggatgccggcgccctccttgaaagtcacattacagttcttgcatcggtagcggatctttgaggtggcaagggggattagggtgcttgctggcgtacaggtggggcagacgcgcggtttggttgagctgggaaaggttctgaaacatttgggacaatacagcggaggcgctgccttttcatgtacgattgtgctgtcagaaaggcattttgggcaggcgggtagcggaagcggcagctttaaggcgggttctttgtcaacgtatctgatacagagattcagggcactgctcagactcagcgcgattggaagaagggctttactatttgacggagacgaggcggccgcaatgcgttttgatacgttctctaggtggaccacatcagatgatttcatatagatgccatttgctcctttcgttttgataattacagtttatcgtgaaaaattacaaaaagtcaacggttagtttggaatatgtagtaaaatgtgttattatgtcaattagtgacgaacatattttttgtaataatataataagaggaattgtatgaaggaaaaacctactataaaatctttgggaaatatttctgaattaagatacataaatgcagataatgtcacgcgctatcgggcgattatgcgttatctttatttgcagtacgagcgtttgagctattggctcagtcctgagcagatctattcaggggttatggaatggaatgttttgaaaaactatacgcaggagcagtgccaactggacttggatcaacttgtttcgtggaaaaatttgacctatcggcatgacggttccagagccagaacggttgaggaatacctgagaaaaaaatatcagtatctgattacgccctactccattgagcttgagcgttttcttgaacacctcgaaggggtaaagggctatggaggctcactggagccgactctgtttgacaagattgcggacagcataacggagatttatgagcatgaaggagattatgaacccaaggctgctctggaagcctggaattcattatatgactcatttcagaaattaaaccagacatcaatggattatattgccagcctgcataccggagcagccgaagatttgatgatgacagcctcatttttaatctataaagattcgatcacactgtatcttcaggactttgtccaggcgctgcagcgcagatcctatcgtatagaaggaaatttgaagttaatcaatcaagagatgcagactcgttttttggggtgcgtattggaaggcgaatggttgattccgaaggtggaggagctcttcacaagagaggaatatctacaaaatctggagcgcagatgggggcaattatgccgctggttttgcggggatgaccagacacaaagcgagatgttccttttggagcaggcatcgaaagaagcgattaagaaaatcgtacggagtacactgcggatacaggaaaagcagcgatccattgtcagcaggcgccgggatttggattatctggggaaatggttctaccgtctggatgatgtaaacgaggcccacaaattggcggcatatgcatttggaatatttccaacccgacatttgcagggggaggacaatcgcggttctgacaaccaggatatttccatgtgggacgagattgctattgagcgcgtaatccgaagccgaagccggaggcgcggcgggaaaggaagcggggagagcgagacgatattcgaccatcatttaaagaaggaggcattaagaaacgaacttgttgcgtatcaaaagcaggaactggaattcctgattgaaatgacaaaaaaaggaaatatgaaagtctcagagctccaatgcctatcagcagttgcaaggatacagctgttgagctggattggaaggtgcatttcatcggaggggcaggaattttatacatccgaaggagtcaaggttacgctttatatgccggaggagaagcagtatgccacattagattgtgaggacggtacattaagcctgttagattattcgtttgtattcgaaatagagaatcaggaaacttggcagaacttgctgaatgggatggctggtgatttagatggctgatagaacagaacgacgcggctttgaagatcataacgagatagaagagcggcgcatgatctgtatgaatgcgttgttgaaccgtccctggatcgagcgggatcaggacccgcagctctatcattgggccagggaacaatatttggaaatacgggattggtttgccaattatccggggtattccgttattatgaacagaaagctgatcaaactggaaaaggttccagttgaggcgaagtgctggatgggttttgaaggatttaaggagcccatcgattatgcgctttttacatacggactatggtatatggaagataaatccgccggggaccaatttattttgactgctatggttagggaaataaaggaatttatgaatgggcagggcttggatgtggactggaaaaattattttcatcggctatccatggcgagggctttaaagaagctgaaaagtctgaatgtactgcgcagcttagacgggcaggaggcggattgggcggcggatgcccagaatcatgacgtgttgtatgaatgcgccccctgcgccagttatgttttgagaacgtttcgcagagaactgtcatcttatcaattcatggaggagttgagcgacctgccggaggaagtggataaaaagaaacggcaaatactgtaccggagatatttgcttgaaccgatcgtgggtatggatttatgggaacaggacttgttttattttcatggacaaaagaaccatataatcggacaactcgataagatgtttggctggggtgggaccaaatatagagaaggtctcttatttttctatccggaattggtgggcgatatggagctttttcctacattatcggccatatcggatcttgtcctgctgttttgcggaacgatcagaactctgtatgagttgggtgaaataaaaacagaatcggtatcgtccggtaatatccggttgaccagaggcagaattgaacagattctgcttgaattgcagagcgaatatggcgaccgctggacaaaggaataccggggaatgaaatcgtcacagttggctgtagcggtgtgcgaacatatggagcagtgggagttcggcaggtggcaggatgatatgttctttgaactgtatccggttggaggaaggtatcatacccaatacggagaagtggagatagaggagtagcatgatgaaacgatggcgaatgaatcgcatgggcatactgaatttctggctttatgatgaagaggtttttgaactggaacaggggagattgctgtttcgaggggcaaacggatcggggaaatctgtgacgatgcaaagcttcatcccgctggtgctggatggagacaagcgcccggagcgcctggattcctttgggtccagagatcgccgcatggaatattatcttttaggcgacaatgagaccggtcatatggatcgaaccgcttatctctggattgagttttatcatgaggagaaacagagctataaaactattggaattgccctgcgggccagaagaggggcggcacagatgatcttctggggttttctactggaagatggaagacgaatcaatcgggatttctatttgtatgattatccgaattggctggagacgaagaaaaaggttccgctgaccagaaaggcattgacggaagccataggggccggcgggattgtggttcaggagcaggcggcgtaccgcgatctcgtgaaaaagaacatatttgggtttaaggacaataatgactcatacaaagatttactgaagcttcttttggagatcaggagcccaaagctttcgaaagagttccgtccgtcctcgatatacagtattctgaccaattcgcttccggcacttacggacgacgagttgggggatctgtcggatgtcctggaggatatggatcagatttcggagcgtctggaggaactccagattcagattcaggaacttgaaggtctggagaagcaatacaaccactacaataaggttttactgtatcaagcgtccctagaattgaaagtacagaatcgcacttttaatgaccgcaagaaagagctggatgattgcaggcggaatttggatagtgcgattgattgtggtatcgcattaaagactcgaatcacgaaggcagaacttgaaattgagaaaatacagtcggaattagattatctcctgcaaagtgagggattggaaaagccaagggaactggaacgtttacatacggattataagaaattgaaggaacagtatgtggcggtcagcagacgaatggctgacaatgaaaaacgggttcaggcatggcaaaaggaaatagcggaaaagaaagcgctgagagacgaattgttttgcaagcaaaacagcttattggaggagttggaaagctatgcgagagttatggagttttatgagcatgacatataccaccggcagtggcagcaggggggagacgactatgtacgctgtgcgaatcattggaatcaggatttgctgacacatcagggaaaattaaaggccgcagtccaggctgccgaaggagaacgggaagccagtttggatatggcaaaggaaaaggagcggtggggagagtgctatagaaagagaaaccttgcggaagaagaatatttacttgcggaagagaaatttggtgtcgagaaaacgcagttgaaggagcggattattagctggcgccaggatcttttacaactggaagtgagtaatgaggcggtgggccatattttaacggcgctatctgaactgaatcaggataaccgcaattatgagtctgtaaaatctacggtgaacaacctgttttttgatcaacatcaacggttgacaaaccaggtacttattttagaacagcggctcagagaattcgaagaacagcgagagcttttgcaggcggagttggattcgtggagaagtcataaagagcctgagccggggcgttcgcccctgagggccaagtgccgtggggagagagcggagcggatgggcgcgcctctttatacagtttgtgacttttccgttgatttatcggaaatggaaaaggcacagatcgagactaccctggagcaggcgggattattagatgcctggattttaccggggggaaaaatgggctattttgcccatgaaaaagatgaggagatctggattgaaccctgcgaaaaccctggagcggataccttacttgacgtgttggagccgtgcccctctgaggcgagtggtttgacaaaagatgatattgcgcttgtgttgtccagcttcatctggagtggggaaacggattgcacacagggggatatgaggctggcggcatttaatctcattggaaaaacgggattccggctgggggctctggcggggcagaattctgcgaaagagcaggcggaatatattggtgttgagaaccgtcaaaaagcaaagaggcgaatgattgaccaactggagcaacaggtcctggagttggaaaatcaacagggcaggatccgggaggacatacgctgggagcacgaaaagcaggctattttgacagcggagaaagagtgcttcccggatgatagggaaattcaattatgtctggacgatctgacaagtaaggtgcatcttttccgggcagcggttgaccaggaaaaagaagcggagcgcattttccataagaaggaggctgtctggaaggaacgaaaagttgaactgaccgaaataacctctgcctggacaaggcttaaaaccctgagcgtactcagggaggcgatgaattgtgtcaatgattataggaccagtctgtcacaactgaaaacagagtttgtgcatttcagaagcctgcaaaatgattgtgataactatcaggggtatatcgacgaggccattgagcaaatcagtgatgatcaattcgagctgagcgaagtcctgaaagcacaaatgttgatggaaagccagataagccagcttgaggagctgattgaggccaaagggctcagagatattttcaataaaattgatcggtgtaagcaagcgaaaaaggatttgaacaatgaggtttcaaaacaacgtgatgaattggaaaagaataacaaattgcaaggcaacctggaagatcagttgcacacaaaacaagaacgcttaaaggaagcatctgagaacctgaaggtttctgtctcaaactggcagacagagatgaagctgggcttggtgtctgttgaacatgcagacacgtacaatctggatgaacgtcgggatattgtgcgtctggcagagcagcttgtgaaggcatataaagatgcctgtgggagcctgataaaggagaccgtgataagcgacctggtcgcagaattcagcaaagtaaatgtgaatctgcgcgagtatgcgttggagcgggaatctctggagaatggacggatcataatccgttccaaccgggatcggatgaaccccatgacgcccagggagttgttaaaagaactgcgggacagggaagcggaacaaagacttcttctaacagagcaggacaaaaaactgtattcagagatcattatcggtagcgtaggaaagtcgattcagttaaaaatacatcaggcgtttgattggattgataagatggatcggttgatgaaacagagaaacacttccagcggcctgagattgtccttgaaatgggttccgctgccaccgcggagtgaatcggaattggacacggacacccttgtcaagcttctcttgagcgacacggaacggctggatgaaagcgagatcaaccggatgattgaacactttagaaagcggattctattggcaaaggagtcggcaaaagaggaccagggctctctgcgaaaatatatcaatgaaatgttggactaccggacctggtttactttccgattggattttcgcaagggagaccagtcgaattaccgggaactgactaacagcagatttaatgtgctgagtggcggagagaaggcaatgtcgatgtatataccgctgtttgcggctgcaaattcccgatacagtaaggttgaggccgatgcccccaagattctggcactggatgaggcatttgccggagtggatgactctaatatgcgcgatatgtttgaacttttgaccgatatggattttgactatattatgacatcacaggttctgtggggatgttatgatacggttcctagtctggccatttatgaaatccatcggccaaaagatattgatgtcataaccctacttcactatcggtggaatggtaagcaaaaattatatgtggagaattagcagcagatatggagcataagaggaacataacggcagaggaatactatagcgatccaaatttgaagggtatgttaaatgctgcttttaacaagtacagaagttacggcagcggtaggggaaaaatcaaacttgtgatctccagtcaggccgaggcccagcggttgcaggcatattttggaccgcgggtcaggggactattgggggaaggcgatcagctgaccatggaaatgagcgcaatagaggaagaacttgggaaacgttttatgctaaccgttccatccttgtataaattgttgtaccatgagccattgttgaccaaaaaggaacgtattgtgaaggcggatacagagtgggaatctctgtttaccaatgtagttgagaagcttcaggacgaagagaatatcaatatagtggacaaagcgttttgtgatttgacctatgattggctatatcgtctctggaaaaaggaacccggttcagggtatcggattctgcaggctgggatgaaagactttgacgctgcgttgacatcacttaaaacttgtttggctgcgctctggtacctgtttatggatcgggagaggctggaactggtagaggggaaaagatcagataaaatctctctcgctgtgctggcgactttcgtttatggtgatcacgcattagatgaaaaaaaagcattggcaggcaggctatttttccgggcgctggaagataattatacacaaaaatatcgtgtaactggagcggcggatcctttggaacatgttccggcttttatgcggaaacggatgatttatcgtttgtatgattttcgcgatgatacaatcagttcaatttttcataagtttacgctggatctatatgaatttatgaaggaagagactgtgaatctgagcaatgtggaggcgatggatgaaatcgagataaattccgatctgtttctgatcgaaaacccttcggtatttctatatttggctgactgtttaagggattatgtgagtggccatggggtttcaaaagaattaatcagagataatttcccgactattatatgtacgtcgggttgtttgcgaacagcagtgttggagtatgtaaggaagtgtatcgagagaaatccaaaatgccgtgtttatttttcgggtgattttgaccgagctgggattgagatgctggaaaagttaaacgaatattttcccaaatatgtatatccgtttaaaatggatgcgaaaacgtatctttccgggctgaatggaaaatgtcgggagatgtcggaaaaagatcgggaaatattggcacaaaagaatagtgagttagccaaattaatggccttacatggaaagaaggtgtatcaggagcgcattactgctgatctgtggaaagtccttttgaaggagattcagcgtgtggagacaatggtatagttcacgtttaaagtaaaacgagtttggagggaaaatggattttaatcctgggatcaatataggggatcatataaccaataatgagttatgtcgactttttaaatgtggaaatatgggaggcatgcggaggtcgaaaaagacaggtacgctgatcattatttctgatcacacgaagaatttttaccatgatgagtggaaagatggcgttttgcattatacagggatggggaaaaatggagatcaagttttagaggggaaccaaaatggaaccctttatcattcggatacaaatggtgtaaacgtgcatttatttgaggtaatagaaaagtctgtttatacgtataaaggaattgttaagcttgcagcccaaccatatcaagcggctcaagaaacgtttgacggggagatgagaaatgtatggatattcccggtaaagcctgttttcaatatagatgaatgggcgatagagattatggagaaagaggcggtaacactttctaacacagaattatataaaagggttaaggcggtaaaacgtgaaagtagaaaacctagaactgtagagactaaggtgtatgatagggatccatatttaaaggagctagtaaaaaggattgcagaagggaaatgtcaatattgtggtgagacagcaccttttatagacaagaatggggagccatatttggaagagcatcatgtcacatggcttgcgcggggaggaagcgacaccatcgataatgtggttgcggtctgtccgaattgccatacaaaagcacatgtgttagatgacgatataactaaaattacgcttgaagaggtggccaagcagaatgttaagagattaaagcgcttgctggcatatgaaagggaaatataggtaccttaagtaggaaaggaacgcgatgaatacaattaatgtagtggctgcggtaatcaaacatggggataaaatttttgcaacacaacgtggatatggggaatttaaaggtggttgggaatttccgggcggcaaggtagaaccgggggaagaaccagaggcagcgttgatacgtgaaatacgggaagaattaaatacggagatagaagttcacgatatgattggtacaatcgagtatgactatccgacatttcatttgagaatgagttgttactggtgtagtattgttagagggcagcttgaattattggaacatgaggcggcaaggtggttagggctcgatgaactttatagcgtgtcttggttgccggcggattggcaggtgttgggggaaatagagggggagatgtagggctggtttgaccataatgagtgacattgcaataaaccatcaaacaacaaaggacacctctcacaatggatataacccaatacgtaatcctcgttcgaggacaggacaaaacctcagaggtagcatcatttacgcgaaactatctgaacaataaaatcaatataagataccacgggggcttccaatcctacgcctacaatcaagccaacgttcgcatcttcgagtctcctcaaatggtcgatctcaacaacaaaatagcatacatcggtgatgttccgctctataacccgcagtgtattctcaatttcggagagataattcggatcattgaattcaatgggaagtcctgtattgtcagagcagatgaattttacacagtagaaaacagcgcaggggatgcagcggcgcatcaaattttagaatatctccgtgatatcgcgcaatacacaacaacgggcacagaggacagcgcttttctgagacaggagctggaccagcttacatttattcacccggagagtgtgttggggcggtatttgctgaagaagccgatcgaacgccgcccggcagaactggaccggatcattttcccattttcgttcaatttgagccagaaaacagcgctggaacaagcgttgacgaattcggtttctgtgatcgaggggccgcccggcactgggaagacccagacgattttgaatatcctggcaaatcttgttgccgtccagggcaagagtgtggcggtggtatccaataacaatgaagccgtaaaaaatgtcagtgagaagctggagaaaaaacagtatcactttctcacggcatttttgggtaaaaaggataatcaggaagcatttttctccaatatgcccattccaaatgtggagggatgggattatagtgtggcagagagtgagttgttacaacaaattcagaaatggaatgtcagattgactgagctcatgaaccaggagcgcacgaaggcaaagctggagcaggagcttcgggcgtggaaattggagcaggagcattttgagcggtatttttccagacaggatgtgaaggaggcggtcaggctgccgctgtttagccgttcgcctgagaagattctggactttttggcagagacaagcgtagcggaggaacttcaactgacaaaagggctgttttaccggatcaaattgctgtttaagttcggcgtttggaatatcaggaagctggaacagacggaagtaccggttctgctttcgttgcagagaaaatactatcaactgcagattcaaaatctggaacagaagatcaaccagctgaacagcgcgctggagcagaactcattcgaacatctgaaggaaatgcatcaggctgcgtcggagaaattattccgaacatacctctacagaaagtaccagaacagcgtgattccggcattcacaaggcggaattacaaggtactgttttcggagttcattaagacatatccaattctgctcagcacgactcacgcactgcgccgctccattccacaaaattatctgctggattatgtgatcattgacgagtcctcccaggtggatcttatcacaggcgtgctggcattttcctgttgcagaaatgtagtgattgtgggggatttgaagcagctgccgcagattacggatcaaaaaattaagagtcgaatcaggacggcggcgccgggatgggaatatgattattttgcaaatagtattctatcgtcgttgatggcggtttatggcgggaagctgccggccgttaccttaagagagcattatcgctgccacccgcagattatcgaattttgcaaccagaaatactatgatggggtactaatcgcatatacgaaaccaaaatcggaggattgtcccttaatactatataaaaccgtcgaaggtaatcatatgcgcagagtgacccgcggagcgtcaaagggagtgtacaatcagcgggagattgatgtcattgtcaatgagattttgaaaaattcagatttagagggcaggtacgaggatattgggattgtcaccccttaccgcaggcaggcggatcgggtggccggggaggttgatccatccatcgagagtgacacggttcataagtatcaggggcgcgagaaaaatacaattatcatgtctacggtattggacagctcgcgggacgggcagcgcggtattgcatttattgatgatccacagatgatcaatgtagcggtatccagggctattgacaagtttgttctggtgacggatcacgatttgtttttcaaaagaggggaacatatcggggatctaatccggtatatgcagtacagtacactggacgaaaatgtggtagagagccggatcgtgtcggtttttgatctgctgtatcagcgttattccgccaagctgcttccgctgaaggcgaaaatgaaccccaaagcccgctatcagtcggaggaagcactgcgcctgctgttggagaaaatattggaacagccggagtattccagatatggatatacccagggagtgctgttacagaacctgttgaatgatacggagctgctcacggaggatgaggcggtatttgtcggaaatcgggcttctttggattttgtggtgttctatcaacaagacaaaagctgcatttttgcgattgaggtggatgggtttgcattccacgaaaaccagccggaacagcttcgaagagacgcgatgaaagacgatattttgaaaaagtacaaattgccacttttgcgccttgccaccaatgggagcggggagcgagagaaaattgagaaaatgctggataaacagcgcgatggtggtgtaggaaccagtgaaattccgaaataaacacaccaacgaagtcaaaaccgcaaaggagtataaaaattgacaccccaatcccaaggaacactcatactattttcagattttgaacagctaaaaaacgaggtcgaaaagctccggacagagctctccatgctgatgctggaacgggactcccttgtgtttgtggaggccaaaaatctcgagatgcggtatatgctagagcttggagcggtcgagtacagggcgtacgaggcccagtgcacggtgctgcgcctcaagcggaagatcgagctgatacagaccaggaagaaccggcaggaaaaaattgtactgccggagatcgaccggattctggaccaggagttcatggagtatcagaaagctttaaatgagaaaatcgacgagatgaatgccgccattgagcggagcaggctgccggttttgtcccaggaagaatccagggaattgaagaaattgtaccgcaagatcgtaaaaattctccatcccgatttgaaccccgatttgaccgaggcccagaaggaattgttttatcacgcggtcgctgcctatgagaacggtgatctacagacacttcaggtgatcagtgagatgctgtcagacccggaggatctggattgcagtgagacgaccatggttcggctggcccatgaaaaggaacgcctgagaaagcttctgaacgcgcttttggaggagatcggacagatcaagtcgcagtttccatttacggttaaagagctgcttcaaagcccggagaaaatcgcggcgcgaaaggcggagctgaatgagctgatcgagcagtatcgggtgatgatttccatgtataaagccaaaataaatgaaatgctgaggtgattcaatgggggaactgacaaatgcgggcggtggcggcctgatcggccttttgcatggcaaaggcgggaatctggcggtccctaagccctttgagcgggacatatttttgttcgacacccatgtggcaggaaccagccatgtggaggggattgaggagctggagccatatctgaatgtggatgataagcttgattttttcagggagccagacaatccttatgataaacaggccatcatgattaaaaatatggatggtgttaaaatcggatatgtgccgaaggccgacaatgtcatttttgcgcgcctgatggacgccggaaagctgctttttggcaggattgcggcgaaagagatgaagggcagctggctgaaacttgatattaaggtatatctgcacgaatgatggggaaatgcgccggtttccgggaaacttcaaagttcccaccaaaaaatctacctcttccccctcaactgtgatataatccataagtgcgcccgcgtggcgcgtgaacattgagacgaaatagttgcaccgcgcctaaaggcgcgcagaatggagattatggtaaaagaattatgggagcaggtccaaaatggacaggaagagagacagaatctcagtaaaatcagacaggtgatcaagaataacggggagcggaggaagctttcggccctggtggagggaaaagagaacgtcctgatcgggctgttgcagtcagaggatgcgaaaaccagaaaaaatgcagcgctgctcatgggggatttgaggaatccgccttttttggcgccgctgtggaaggcctatcaggaggaggagcagagatttgtcaagagttcgtacctgtcggcaatggaaagttttgactatcggaactatctggatgctttgaaggagcgtctggctgagctgaaggatgaaacggtaacagaagaaaaccagaaacatgtgatggaagaattgcgaaagctgtccttcctgattctccatatagaaggggtttctgcccaccggtttaccgggtggaacgaggcgtacgatgtctttttgatcaccaaccggaatttccgggagctgacccgcgatgagctgacggcgctggaaccaagcgccaaaacgaagctacttggggccggtgtgatggcgcgggttgcgaacctcaactggatccgggagatccgcacctaccaggagctgctttttgtggtccggggaatggagaccagtgaaatggagccggagcagattgcaaagaccattgcgaattccccgctgctggcatttctggcaaaaagccacgaggggcaggcgccctattatttcaggctggagttaaagagcaaaaaggacctgggccagaagagcgcgttcctgaagaaggtatccgccagaatcgagtcattatccgaccggaaactgatcaatacaacggaaaattatgaatttgagctgcggctgattgagaacaagcttggaaaatgcaatatcatgatcaagctgtttacgctgaaggatatgcggtttacctaccgtcgggacgtgattcccaccagcattcggccggtgaacgcggctttgaccgcagcgcttgccagggaatatatgaaggaggacgcgcaggttctcgatccgttttgcggagtgggcaccatgctcattgagcgccacaaagcggtccgggcgaacacctcctacgggatcgatattctggaagaggcgatctttaaagcccgggaaaatgccgaggcggcaaagcaggtgattcactttgtaaaccgggatttctttgagttcacccacgactaccggttcgacgaagtgattacggacatgccctttaagatggggcggttgacagacgacgatgtccgcggcatttatgaacggtttttccagaaacttccagagctgctgaacgatggcgctgtgctgattttgtatacgcataatcatgaggacgtggcgaagctgacgtttcggacaagcttcagtattctgaaagattacgaagtgtcgcaaaaagaagggacgcatgttatgatccttcggtatgcagagaaataactgccggttttagaacgggaaaggaagttcatggatcacacagtcagaagcaacattaaaatcggggcagcggtgaacgttgtccagaagcaggaccagggaaccggaaaattgacgcagggcgtggtggcccgtattttgacaaattctcccaatcatccgcgcggcatcaaggtgaagctggagagcggaattgtcgggcgcgtccaggaaattatcgggtgaaaatggcggaaaattggttccgcattataatgaaaactcacaggagactaaatgcaatttaaagacttaaatattatgcctgaaattctcagggcattaaagaatgaaaactataaaattcccacccccattcaggaggaggcgattcccgttgtgctgagcgggcgggatctgctgggctgcgcccagacgggcacgggcaagacggccgcgtttgccattcccacgctgcaaatgctcagcggggaggagacgccccgttgggaaaaacggaccataaaggcgctggtggtgacgccaaccagggagcttgccatccagatttacgacagctttaatacctacggccagtttaccgacctgaaatcctgcgtggtttacggaggcgtttcccagaaaccgcaggaggagaatttaaagcggggcgtggatatcctggtggcgacgccgggaaggctgctggatctgatggatcagaagattgtgaatatcgagaagatcaaaatcctggtgctggacgaggcggaccgcatgctggatatgggatttatccacgacgtgaagaaaataatcgcccggacgccggcggagaagcagacgctgtttttctcagccacgatgcccccggacattgccaagctggcggctaaaatcctgaaaaacccggagaaaatcgagatcactcccgcggccactacggtggaggccatcgagcagtatctgtattttgtggacaagggaaacaaaaaggatctgctgctgcacattctgaagacaaaagatcttgactcgacgctggtatttacgcgcacaaagcacggggcggaccgggtggtccggcagctgtcgaagagcaatgtggtcgcccaggcgatccacggcgacaagtcccagggcgccaggcagagggcgctgaacgattttaaggataaaaagctgcgggtattggtcgcaacggatatcgcggccagaggaatcgatatcgacgagttggcctgcgtggtcaactatgatctgccggatgtgccggagacctatgtgcaccgcatcgggcgcacaggccgggccgggcttgagggaatcgccatctccttctgtgacttcgacgaaaaagcccagctcgcggatattgagaagctgatcggcaagaaactgaccgaggtggcggaccacccgtacccattacaaaataatttcccgtcggtgaaggcaacacagccgaaacggggcggggggaagcgcgcgggtcaggcaggagcagcgcagggaccggcgaaaaagaaagagaaaaaggcggtgccgggaacggtggagtccgaggagagattgtcgaaaaaatcacaatcaaccgcagcacggacgccgaagaaatcacggccgtccgaagcgctgcagtcgaagaaaacctcatcccaggggtcccgtcgccaaacggaaacttcgatatcgtcagcgtcatcgccccacaaaacgccggctccggcagcgcgttcacaaacgaagcggccggcccagggagccccctcatcaaaccgggccccggcccagggagcgccttcatcaaaacggtccccagccccggcagctccaacgccgaagccagcctcaacgccgaaaccaacgccgccccagcccaccccatcgccccagaaacgccggagaaatcccttcagtggcctgctgaggaaaccgtgaggcggctttcggtaaaaactacgcagctcccattgacaaccctcatccctcgtgctaaactataccaacaatcaaacaacaacccgtcatgagggagtagttagcattcaaatatgtggcaagtcaacatactgaccgcagagcggtctggcttgtcttaaataacgagactcatgtatagctgattccggctatacatggtctcttttttagacccagtgtagcagttaccggctatacctgggtctttttgattgcagaaaacgatagaaggagaggaacatgacaaacgcatttatggaatgtccggaggaaacgctggcccgtctgaaatcggaccgggaaaaagggctcacggcccggcaggcaggggagagccggaaggcaaacggtgagaattctttctcaaaaagcgagcagaaatcgctgtttcaccgtatctgggaggcggcaacggagccaatgctgatcatgctggtgattgccgcgattatcacgctgggggtcaacgcggcgcggtatgtgaccggcggggaggcggattttctggaatgtatcggaatctttgtggcgatttccctgtccgttgtgatcaccgtggtgatggaggggaggagcgcgaaggcttttgaggccctgagccggatcggcgaggatatcccggtcaaggtgatacgggacggtaaagtctgcctgatacccaggagagacgtggtggtgggggatattctctgtgtggagacgggggataagcttcccgcggacgggcgtctcctggagagccacgagctcatggcggacgagtcggccctgaccggcgagagcatgccggtccacaaggaggcggggattgtgtttgacagcccgcaaacgccggtggcggagcgcaggaatctgctctactcgggttgctttatcaccgggggaaacgggaaaatcgcggtgaccggcgtgggggaccacacggagttcggaaagattgccagggagctggcctcagcggacagcggcagcacgccgctgcaggagaaaatggcggcgctgggaaagcggatcacgatcctcggctcggcagcggcggcggtggtatttctgatccagctgatcctgttcctgtcgaacggcacggcttctctggacacggtgtccgaggcgtttatcaccagcatcgtgctgatcgtggcggcggtgccggaggggctgcccaccatcgtggcggtgtccctggccatcaacattatcaagatgtcaaagcaaaatgcactggtgcgcaagatgatcgcctgcgagacggtgggctgcatcaacgtggtctgttcggacaagacgggaacactgacacagaaccgcatgacggtgacggatattttcagccacatgcggctgctgaagccggaccgtctgaagaaccgccatttgttggacaatttttgcctgaacagcaccgcggacgtgacgtttgcggacggtcgggtgaaattgatcggcaaccccaccgagtgcgcgctgctcaccgccgcccgtgaggcgggccgggattatgaggcggagcggcgccgggcggaaattctttacgtctacccgttcagctcggagaccaaatacatgaccaccgtggtgaaaagggacggggaaattgaggtcctggcaaagggaagcccggagcggattatggagctgtgcagcctgtccgtagaggaacgggaggcggccaggcttcagatcgtgaaatttcaggaaaaagcctgccgcgtgatcggatttgcccacagaaggacggggcctgccgcggattacgagggctgccgcgccgcgctggaaacggacatggtgttcgacggtttcacggccatcacggacccgatccgggcggacgtgtaccaggcggtggaacgctgccggcacgcgggcattgagctgaaaatgctgaccggggacaatctcatcaccgcccgggccattgcaaatgagctgggaatcctggacgcggagcacatcgcggtggaggcgcgggagatcgagcgcctgtcggacgaggagcttcaaaaacgcatcccgtccatccgcgtgatcgccaggagcacgccgtcggtgaaaatgagggtggtgaacaccttaaaatcgctgggaaatgtggtggcggtcaccggggacggcatcaacgatgccccggcgctcaaacacgcggatgtgggcatcgccatgggcatcaccggcaccgaggtgtccaaggaggccagcgatattgtgttgctggacgacagtttttccaccattgtgaaggctatccagtgggggcgcggaatttacgaaaatttccagcgctttatccagttccagctcacggtaaacctgtcctcggtgattgtggtactggcctccattctggccgggtttaccgcgccttttaccgcattgcagctgctgtggattaacattatcatggacgggccgccggccctgacgctggggctggaacccatccgcggggatctgatgaaccagaggcccacgcccaggaacgccagcattgtgtccaaatccatgcttttccggattgtgaccaacggcgtttacatgtccatcgtatttatggcgcagcacagcctgaattttcttggcggcagcgaacgggagatgccaacggtcctgttcaccctgtttgtggtgtttcagctgtttaacgcgctgaacagccgagagctgacggatgtgagcattttcaaaaatattgcaaataaccgcctgatgttgggcgtgtttggggcgaccttcgggctgcagtttgtgatcacccagtttggcggtatgttttttaacacggtgccgctgccggcggccatgtggggaaagatactggccgttgggtccacggtggtcctgctgtcggagggcgttaagatggtgaagcggggagccacagcggcgcagaaacaccagggcgcggaagctgtctgctgacgggagatattttgccgcattgtttggcggagacggattacacacaggtgtgtccgcctccgccttttaatgagcgcaatcagccgctgtcgcggtctgcggacgacagtttcccgagggagacgatggaggcgcccggttcattttcatccggcaatttgacggctgtggtccggctgttatcgtaggttctgaaataatatcccggttgggacagatccataaacgcggtatactgcgtgtaatccatggtgccccggtcggtcagcacaatccccttggggatgctgacgccttccagaatatggaacccggcgttgatcgtctcaggggttccctccgtggcggcggcatgtgttttctggaacgcggtccgcacaaatcgggacggaggcgtgtagtccccgggaagcccccaggcgcccgcgccctggccaaagggagtcagatttaccggcccccaatcctgacttttggtctgagtgggagagaggttgagataactccgaaggttggtcaaatgccacggaaagtccgggctgttggtcagcacgccgacgggattatccaggatatgaaggccgtcggctgttttttcaatgaccatggaatttccgctggcgtccgcgatcatccagtgcaggggcgccaccgtgccggtgacagagtcctccacgccggtgatccgcaccgtgcgcagcagcgaggcggcctggtccagggaagcgcagagccctaagagaaacctgacgatttcaagagccgccacggggacccgtgtgtctgccccatcgtccgttttggcggagtcataatccgcgtacccgggaaaatagagggcggcggccgcaaatccggcttcgttgacgccgtcggcgaagatcacggaggagaggtcctgcccgatgcccatatagcggtaacggttgcggatttgatgagtccgaaggaggttggtccactgaaaccctctgggcataacgtacagttccgggtctaagggataggagaaatccatggtgcggccgaagaaggcggccccctgggtattttgcagcgttatggcagtgcacatattgtttgttcctccgtttcggttcgatgtgatatagatatgtatattaggtcccggagcgaatcatgcggaggcggggaagcgcgctggaattccggtaggacgccccaaaatcccgttccacctgatttttcccctctcccgtcattctcatgtatcccgcctctcaaacctggaaacaataaagattaacaaaaattggaaaggaccggctcatatgaatgcacgtttcaaccgtctgaaaatggtgaaaattgccggaggctgctttctggccatgacaatcgccgggggtcttaacctgcggtacggcgcatcggcgggggtgatcgccctgctcagcattcacgataccaagcgggaaaccgtctacgccatgttgaagcgcctgggggcgtttgcgatcgccctggcgctggcccccgtctgctttgggctggcgggctacacgcccctggccatcggagcgtttctgctgctgttcgccccggtgtgctcgctgctgcaaatccaggaagggctgtcggtgagcacggtgctgatgacccatttcctgacggaaggggccgtgtcgccggaaacgattgcaaacgaggcgcttctgctggtcgtgggggccggcgtgggggtggggatgaatctatatattcccggaaagcgggagtggatacggggacagcagcttcgcattgaggagcggtttcgggaactttttctggaaatggccgcatatcttcagggggaaacgcggggggacaaaattgcggaatgcctgagcgggttgagcggcatgctggatgagggcgaagccgcggcctaccgggatatggagaacaatctgttgagtgagacggaatactacctgcgctacatggtgctgcgcaaaagccagctggcggtgctgatccggatttcagaccatctgcaaaggcgggaggcatttccgaagcaggcgaagtggctgtccgggcttatgcgctccgtcagccgctcctttcacgagtataataacgcgctggggctgctggacgagctggcgggggtgaaaggggagctggggcgggaagccctgccggccacccgggaggaatttgaggcgagggcgatcctgttccaggtgctgctggaactggaagagtttttacggatgaaacgggaatttgtggcggagttgacggcagaggagattggagaattttggaagaacgacgtgggcagccgggaccgcggctgagaaaaggaggctggaacgcagccggaacgcagccccgaggcggttaaaaacccatcaataacccactggttcacatttcaccttgctccccctcctaaattgcgcgataataaatacaatgttcccagtatggggaaatttgtatatactgccgccgcgttttccaaccgcaaccaattaaaatgagtgagggggaattgattgaacaaatttaaacaattataggaaaaagatatagaaataatgcataaaaataaagataaaacttagataaaacatacaaagtgataaaaaatatcaaaaacttgttgcgaacttgttcaataagtagtataaaaagaatagaacaagttgaacaacctgagatatttggaaacggcagaaaacgcagcgaataccaaagagacaggagaagaaaaatggcagacagcaaaatcagctcaggagagtatatttttaacaagttaaaagacaagatccgcagcgggcagtaccaggcgggcgacaaactgcccacggaaatggagctggcggaaaagtattcggtgagccgcaatacggtgagaggggctatcaaccggctgatcacgctggggatggtggagtcgttccagggaaagggcacgtttgtgaaggagaccaattttaccaacaagatcgagaatctgatccccatgtttttttccgagggcagcgattatctctcgctgatgaatctgaggaccgccattgaatcccaggccacctacctggcggcccagaaggccacctaccgggacgtacagcagctggaggcgattgtggaggatttggagttacataaggacgacctgctttactgtgcggagcatgacattaccctccactttaagatcgcggagatatcgggtaaccgtctgtttcagtccctgattgaaatgatccgcaatatgttgaaggacgtactggaggattttatcatggatttcggaaactatgagagcatgatcgcccaccggaacattttaaacggcatcaaggcggcggacccggacatggccagggccgccatgcagaagcacatgcagaccgtgatcaaccgttacatggctatgccgaagaaactggacgaggagtaggggcaaaagcggtttttctgaccgcgctccggggtttaagtattgggggattgcttacatgaaaaatctggtggagtttaaacacatcacaaaacgttttcccggcgtactggcgctgaacgacattaatctggagctgaaggcgggggaggttcatgtgctgatcggcgagaacggcgctgggaaatccaccctgatgaagattttgtccggcgcttaccgccaggacgagggggaactgctgatcgacggcgaggcggtgaagcggaattcaccgatcatctcatcgtccctgggcatcgggatgatttatcaggaactgaacctgattcccgagctgtccattgtgaagaatatctttctcgggagcgagcggaaaaaggggattttcgacgaccgggagtatatgtatcaggaggcggagaaatatctgcagatgctgcacctggatatcgatccggacaccctggtcaaggacctgggcgtgggcacccaacagatggtggagatcgcaaaggccgtctccaagcgctccaaggtgctggtgctggacgagcccaccagctctctgacggactcggagattcgggagctgttctccatcatccgcatgctgaaagagcagggggtgggcatgttctatatctcccaccggttggaagaactgtatgagatcggggaccgggtgaccatcatgcgcgacggagccaaggtggggacgtaccggctggacgagattcggatgaacgagatgattgaaaagatcgcgggacgaaagatcgagaacctctatccgcgcaaccgcatcccgcctggggagtgcgtgctggaggtgaaaaactgttcgggcgccgggtttgagaacgtcagcctgaaggtgcatgcgggggagattgccggcctgtccggcctggtgggggcggggcggaccgagcttgccagggcgatcttcgggatcgacggctaccattcgggggagattcttctggaaggcaaaaaggtgaagaaaaacagccccaaggaggcggccagagccggaatcggcctgctgccggaggaccggaaggtccaggggctggcgctcaaaaagaatatccgggaaaatatggtggtctccgtgctcaacagtctgtttaaaaacggcattgtagacacgaaaaaggagcgcacagtctgcaaccggtatgtggaggagctgcagatcgcaacgcccactgtggaaaagctggctggcttcctcagcgggggcacccagcagaaggtggtaattgcgaagtggctgatggcggatctgaagctctttattttcgacgagcccaccaggggtatcgacgtgggggccaagagcgagatttaccggctgatggatgagctggtacaccagggggcggcggtgctgatgatttcctcggacctgccggaggtgctgggcatgagcgaccgcatctacgtcatgtcccagggaaagattacaggggagctgggatatcaggaggcggaccagaatctggtgctgcggtacgcgtacaatcaggggggacaagcagatgaagagagataaacaggaattttcattcaagaagctatgttcaaacttgcccaattccacctacatatttgcggcgctgttccttgcgtttgtaatctttatcccgaatttcggctcggcgaccaatctttccaccctgatcgggcaggcggccattctgatggtgttgagctcggccatgtctctggcgattatcacggggggaattgatctgtcggtgggcggtctggtctcactgatcggaatcgtgatcgcgcagttaatcgggcggggtgtgaacgagggggctgcgattctgctgggcctgctgactgcggcggcgttcggtttccttaacgggattgtggtggtgaagctgaaggtggcgccctttatcgcgacctttggcatgatgggagtggcccagggcctggccaacaccttttccaacagcagggcggtgtatcttccctcggaaaacatcacggtaattccggttttgcaaatgaatctgctggaatggatgttcccttcaggaaatattctgaccatcaacgtgcaggtgctgatcacggttctggtactggcggcggtcatcttgctttttaagaaaacggttttgggcacctatctctacgctctgggcggcaaccgggaggcggccaagctctccaacatccgcacggatgtctggaatatcggggtgtatgtgatcaccgggctgttagcgggcgtcgcggccctgctcatgctcctgcggctgaacagcgcccagccaacggccggggacggtctggagtttcaggcggtggtggcggccgtgctgggaggcaacctgctggccgggggcaagggcagcatccccggcgcgatcatcggggcgttggtggtttacacggttcgcaacggcctgtcccttgcgggggtcaataccaacgcggtgatggtgattctgggcattgtcctggtgttgggcatgatgatgaacgagttcgcagtaaaagggttgagaaagaagggggcgtaatttatgaaggataaaagcaaactgtacgatttctccacatttttaatcctgattctgatcaccctgtttttcactgttttcgggaagggctttctgaagccggggaacatttccaatatcatcaatcaggcctcctttctggcgatcatcggcgtggcgcagctggtggtgattttgaccgggggaatcaacctttccatcggttccaccatggcgctgtccaccgtgctctgcggtcccatgctggtccgggaagccaatgtgccggtgatcctgccggtgtttctggtgattttgttcggggcggccgtgggaacggtcaacgggctgatgatcaccaggttaaacatcccggcgtttcttgccaccttcgccaccatgtacgtggcccggggcgcggcgtggctctatatcggaaaaggggtgttttacgggatcaacgatcaaatccgcttctgggccatgggcgagctggtcaatctgaacggattccgtatcaccatgcccattgtgctggtggccctgttcctggttgtgatgtggtttctgctggccaagaccacgcttggacggcggctctattttacaggctccaacccggtggcggcggaattttccggcattcccacaaagcgcgtgattgttttggcccatctgctcagcgggctgatttccggaattgcagggatcatgtacgtggcgcggatcaacgcggcggacgcaaacctggggacccagtaccactttgacgccatctccgtggccctgatcggaggcgcggtgatgtcggggggcgtgggaagcgtctggggagtagtgggcggcgcattgatcatctcggtgattcagagcggtatgaacaacatgcagattcccacggagattcagaaagcgtttttaggcgtgatcatcatcctggccgtattcttcaacgcgttccttcaggaccagaagatgaaggcgggaaatgacaagccggtgaaaaaaggaaacacagcaaatgcttaaccattaaaagaggaggatttcattatgtttaaaaagttgacggcggtaactctaagtctggctttagcagcagcttctttagttggctgctcaaacgtcaagggaaccaacgcgggggcgggcaccactgcggcggcgtccgaccagcccggcggcggacagacggcttccaccgggcagaaatacaagattgcctttatcgtcaagagtctgcagtcggcatttttcatcaacatgaccgaggcggcggaaaaatgcgggcaggattacgcggataagatcagcgtggagattatggcgccccagactccgttcaatattgaggaacagatccagctggtggagcagtgcatcaccaacaagatggacgccattgtgattgcgccctgcgattccgagggaatcgtgccggccatcaagaaggccaacgacgccggaattctggtggtcacggccaacaccaaggccaacggcggggacatcgtctcctatgtgggcgcacagaacttcgacgtgggctacagcctggccaccgcgctgtttgagaagttaggcggacagggcaaggtcattcttatcgagggcaaagcgggcaactccacctccgaggagcgcgccgagggctttaaggaagcgcttaaggagtaccccggaattgagcttctggccagccagccggcggactgggaccgcgcctccgccatgacggtgatggaaaactgccttcagacctatgaccagatcgacggcgtgctgaccctgacaaaggacatgggactcggcaccatcgaggccatcaaatccgcgggccgggacaaagagatcgtgtctatgacctttgacgtggacgacgacgtgatctccgcactgaaggccggagacctgtacgcgtccggcaaccagaacgagcagagccaggcatatatcgccatcatgacggccgtgttcgccctggacgggtacaaagtggacagcagccagattatgccgatcaccgttgtgacggcggaggattttcagtaagcagcaaatataaggagaggtgtgcagactatgatgaacaaaaagaattggtatacaacagaggaaccgtccgttttttttgaggacacgtccgtgggaagaatgaaaaaacagctgtgggaggccagcgaggaggagatcgaccacattttggaagaatatggaattccttctccctccgagctgggaatggccaacacctatatccagaccaccaaccgctccagggtgattgagcggaggcggaaaaacgatatcgtgttcgtgcccatcggctgtacggaaaaccacggaaagcacgccaacaccggcctggacacctttatggtgacgcagattctggagggcctgcgcaggtatacggcaaagcagggcagggagtgcagcatcgccttcacacctctcaactacgggggacacccctaccaccatatcgccatgcccggaaccgtgaacatgccccacgaggtggtgcaggagaccattatctacatgatgcttgggctctggaacgacggcttccgcaagatcatcctggtgaacaaccacggccatctctggatgctggaagcggcgatccaggagttctgtaaacggttccagctgcccggcattttccgggtaatcgactggcaccgggcgatccgggaattcttcatccccgtggaccggggggacagctttgagaccaccttcatccacgcggatgagatcgagacgtccatgggcatgctgctgttcccggagatgctggacatggagcaggcggaggaagcctggcccaagggctatctgccggacggacatttcgacgtgtcggtggacgcctacaggaggccctgccgctggagcgagggccagggccatcaggccatcgagattgcggggacgccggagggagtggtgggcaatcccaagctggccacggccagaaaggccaagcgtcccaccgccgctattttgaaatacctgactctggtgcacgatgaaattctggaagcatttccggccggcacggtgccgcctgtggaggaaatgacgctgcggaccgaggcggagatggagccgtacctgagagaaccgctcagcgagggctggaagtccgtttacggcattcccaggatcggggcgtttgagaagctttaacctgcgcgatacaaaacggccggacggcagatttttaagattcttaaaagtctgccgtaagctttagaatggggaggaaaatatgaatctgtttgatttgaccggaaaaaaggcgatagtgacaggctcctgccagggcctggggaggagcatcgcggaggggctggcacaggccggcgcgtcggtctgcctgatggatttgaacccggactgcgccgctgtggcgcaggaaatgtcggctgggggtctggccttcgagggggtgaccgcggacctgacggaccggaaggacctggagcggggctttttggaggcggtaagcaagctggaaggactggatattctggtcaacaacgccggaatgcaggtgagaggcgacgcagaggagatcgagctgtcccgctgggacaagctggtggagctgaacatcaccgcggtgtttgagctgagccagctggcggcccggcagatgatcccccagggcggcgggaaaatcatcaatgtggcctccatgctcagctttttcggcggtttccgatgcagcccctacgcggcctccaagggagccgtggcccagctgaccaaagcctgttccaacgaatgggcgggaaagggcatcaatgtgaacgccatcgcgcccgggtacatggacacgcccttaaacacaacgattatcaatgacccggagcgcaaccgggagatcacgctgcggatcccggcccaccgctggggacttcccgaggatctcaagggcacggtgatttacctggcttccggggcggcggattatgtgtctggggcgattatccccatcgacggggggtatctgggacggtaaggaggcggcatgaagacggaaacggttttagaatggattggccgggaaatggtgattgcgattatacggggcgtagggccgggacagatactggacacggccagggccataaaagcgggcggtatttcaaacatggagatcacctttgaccacggcacgccggaggggatcggagatacgctggaatccatccggcgggtgaaggccgggctgggagaccaggtcaacgtgggagccggcactgtgctgaccgcagaggaagcagagctggccgcggaagcgggggcggagtatatgatctcgccgggcatggaccctgcggtgatccggcgcacaaaggaattaggcaaaatatccataccgggcgctcttacccccacggaggtctgcaaggcctgggactgcggcgcggattttgtgaaaatgttccccgccggggtgttgggcctggaatacttaaaagcggtccgcgggccgctcaggcatattccaatgtgcgcggtgggcggcatcagccctgaaaatatcggtctgttcctggatgcgggaatccgctgctttggaatcggcggaaacctggtttccgtggaagcggtccgcagaggggacttccataaattgacccaggcggccattggctaccgccaggccgtctgccggtggcaggaaaacgggaggggagagagatgagtgttgtaaatgacattataaaagacataccccttcccaatatggtgaaggtacgtcaggatttcgaccgcacccgcctggagaatgtggcggcggaggtgaggaaaagccttgagcggagggaaatcctgggaaatctgaggccgggtatgacagtggctgtggcggtgggaagccgggggatcagcaaccacgcgctgatcgtgcgggaaactgtgcgctttttgagggatcacggggccaggccctttatcgtatcttccatgggcagccacggtggagccacggcggaggggcagcgggcgatcctggaaggctacggcatccgggaggaatactgcggctgtccgataaaggcaggcacggactgcgcactgatcggatataccggcgacggcagcccggtctacatcgaccggtatgcggcggaggccgacggcattgtgctggtgaaccggatcaaaccccacaccgcgttccgcggcccctacgaatcggggctgatgaaaatgatggccatcggcctgggaaaacagaagggcgcggagacctgccacgcggctggttttgagaacatggcggaaaacattcccaggtttgccgccgcggtgttgaaaaactgcaacatactggccgggatcgccattctggaaaacgcttacgacgagaccagggaggtgatcgcgctggcggcggatgaaattccggcgcaggagccggagcttctggagcgggcgaagcgttatatgccccgcattctggtggattatgtggacctgctggtggtggggcaaatcgggaagaatttttccggggacggcatggatcccaacattgcaggtacctttgccacgaaatgcgccagcggcgggctgaatacaaaacgtgtggctgtgctggacatctccgacgagtcccacggaaacggtgtggggttcggaatggcggacgtttccaccaggcgggcctatgaaaagtttgactttgagatgagctatcccaacgccctgacctgcttggtatcccaggtggtcaaggtaccgatgatatttgacagcgatcagctgtgcctgaaggccgggatcaagctctgcgccggcatcgagcacaggaacgccagggtggtttatatccacaacacactgaaattgggagaaatttatatatcggccaacctcgtaccccaggcggaggctgttgagggcatcacggtggcgggggaggaacggcccatggagtttgacggaaacggaaatctgatttcaatctgaagagggatggaatatggaacagtatatcattacaatcgacggcggaaccaccaacacccggtgcattttgtgggacaaccgccgcaaccgggtaggggaagaacggcgggaggtgggagtccgcaacacggccattgacgggaacaacgagcggttaaagcaggcggtgaaggaatgcctggaatgcctcacccgggataacggcgtgggctgggaccggattcaccggatcatcgccagcggcatgatcacctcggatgtggggctggtggtggtgccccatctgaccgcgcccgccggactcgcggagctggcagaggctacggtggccattcagatgccggaaatctgcccgatccccatctattttatcccgggcatcaaaaatttctcccaggacgtgacctttgacaattttgaagctatggatatcatgcggggggaggaggtggagagcatccccatcattgagaaataccacaacggctcccccatgattctggtgctgcccggctcccacaacaagttcgtggccgtggacgagaaccggaaaatgaccggctgtctgacctccatttccggcgaattattggcctccatcaccaacgacactattatcgccaaatccgtgggaaaacggttcctggacgcagtgaactatgaccgggaatggctgcttctgggataccgcaacgcgaaaaagaccggccttgggcgcgcctgcttttccgcccgaattctctacctctttaaagacagccgggtggagaagattcagaactacattctgggcgcggccctggccggagacatcacggcgattatgaattccagcgccgtccgggcggaccggcagacggtggcggtggtgtgcggcaagaatccgttaaaacaggcgctgatggacattatggagtgcgagggcatgttctcacgggtattctcctatgagccggaggagggaatgtccacctcggcgctgggggcgtacatgattgcggagaagagcaaaattatatagggggacggttgagatgagggttgtgattacggattatcagtacgacaatgtggatgcggagcgcaggcttgtggagggcgcgggttttgaactgctggattaccaggtgaagacgccgggggcactgatcccgctggtgaaggacgccgacgccatcattacccagtatgcggatattgaccggcaggtgattgaaagcctggaacattgtaaaatgatcatcaaatacggcatcggcgtcaacaatatcgactgcagggccgcgggggagaaggggatctatgtctgcaatgtgccggattacggcgtgcacgaggtttcggaccaggcggtgaccatgattctgtgccttggaaagaagctggagccgcttcaggaggatttgcgccggggcaaatgggggtacggcggaatcgtcccggtgaagcgttttacggagtgcaaggccggactcatcggttttggacggattccgcagatggtgtgcagaaaattgcaggcctttggcatggagattctggtttacgatccctttgtggacgatgccgtgatcgaggcggccggggcggtcagggcttccgtggaggaaatctgcagaaacgcggattttatctccgtccactgcccgctgacagaggagacgcgccacatgatcggggagaaggaatttgccatgatgaagccggagtgctgtattgtcaatacggccaggggcggcgttgtggacgagcaggcgctgatcggggcgctgaatgaggggcgtattgccggagccggcgtggatgtgttcgaggaggagccggtttccgtttaccacccgcttcttcacatggaaaatgtgatcgcaacgcctcacagcgcatggtacagcgagaccgccatcaccacgctccagcgcaaggcggcggaggaagtggtgaacgttctgcagggaaatgaacccatgaactgcgtgaaccggcagtattttcaatagaagatgggctgggccgcgcttacaaaacggaatgtgcttgcgctgtccctggggatttttttcgacgccctgggggtggcgctggtgacaaagtcggatttcgggatatcggcggtttcctccgtggcctacacgctgagcagcgtctttccggccatgacctttgggatgtggagctatacttaccagttcggactgtttgtgcttatgtgcctgttggtgaagcgctgttcggccggttatgtcatgagttttatgattggggtggtgttcgggtacacgctggacgtttgccggcttctggtcgcgccgcttcccttttgcccgctgccacgggttgtgtatttcctggcgggaaccgggattctgatcaccggggttgcgtttctgatgatctccaatctgccgattatgccgcaggatctgtttacaagagagatttccgcacatttttccctgccctttaaggttgtcaagacggtgtttgacctctcctgcgtgtcgctcagtctggccgtggcgtttctcgcgctgggccggattgcgggcgtgggggcagggaccctggtgagcgcgcttatcacgggaaaatgcgtggatgcggtgaagcggcggctattatccactaaacggtttggataggggatgcaataacccgcaggctgaacctgcgggttatcatttcgtggagacaacagggctcgaacctgcgaccttctacacgtcaagcagacgctctcccagctgagctatatctccatgcgaacattatagcataacaattaatcaataggcaacacaaatttatcttaaatacagaatcgaggcgacaagattcgaacttgcggcctctgcgtcccgaacgcagcgctctaccaaactgagccacgcctcgatattgttctgtggcgaacggtaattatcatatcactttaatcgcaaaaatgcaagtgaaaaatgaaaaagaaggcagtggtcaactgccctcctccacgatctgctccaggacgcggatcaggtcctgaagcgtgtagagctgtacgttccgctccagaatgtcgtttttcaagtcaatggacaacgactcgaatttgtcccggattttcggggatacataagatgccatacaatcacctccgggaatagtatgccatttcgcggacaatactattcccggaggtgacggagatggaagagaagaaacagggagaacagaaatccaccgaagcgctggagcgccaggccaaaaatgtggaaacattcaacccatattggaataatggtgaatttctgggaccgaataccacgcggcatgaagcggacgtggacgtttacggggagggggagcagtgatgcttcccctctctttgggtataagtccggaagttatccacaataatgtggaaaagcctgtggataatttgttagtgtctgacattatgtgcataacttgtgttcaaggcagaatagaacgccgatttaagcggtggaaatgcgctgacagatagagtataatgataggaggaatttgtttgcgggtaatgaccggaaaaggagagtgtatagacgatgaaaacgataatcaaaaatggtatggtggtatctcctgcggagacctacgaggcggacatcctcattgacggggagcagattcgctgtatcgggcggaatctggcggacgaagaagccagggtgatcaacgctgcgggcaaatacgtgatccccggcgcggtggacgtacatacccacatggatttgcaggcgggcagttcccgggcggtggacgacttttatgacggcaccgtggctgcggcctgcggaggcactacctccattgtggaccacatggccttcggcccgaagggctgcgatctgcatcaccagctggccgaataccaccgcctggcggacggtaaagcggtgatcgactacggctttcacggcgtggcccagcatgtggaccgcggcatactggatgaactggaagccatggcagaggacggcgttcccagtatcaaggtgtacctgacctacgatttccggctgaacgacgccgaggcgtttcagattttaaagcgcatgaaagagctgggcggggttacggccttccactgcgagaaccatgacattgtggaatactgccgcaggacctgcgtggagacggggcgtaccggtcccatttaccacgccaagagccgccccaacctggcggagtccgaggcggtggcccgggtgctgagcctggcccggctggccggggacgcgccggtgtacatcgtgcatttatcctgcaaggagagcctggaggcggtgcgggacgccagacggaaaggccagaagaacattttcgtggagacctgcccccagtatctgacgctgacggaggagaaatatctggatccggacggccttaaatacgtgatgtccccgccgctgcgcactgcctcagactgtgaagccctctgggagggattggcctgcggcgatatccaggtggtgggcacggatcactgtcccttcaatttccacaaggagaagcagctgggaaaggacgatttcaccaagtgtcccaacggcgcgcccggcgtggaggagcgggtgccgctgctgttctccgagggcgtgctgaagaaccgcatttccttgaaccgctttgtggagacggtctgcgccaacccggcccggatttacgggctgtacccgcagaaggggattttgcagccgggagcggacggggatctggtgattctcgatcccaccgcagagtggacgatcacccacgacaaaatgcacagcgcggtggactacacggcctacgaggggatggcggtcaaaggcaaaatcgatctggttatgcagcggggccggattgtggcggagaacggggctttcaccggcgagagaggcgcagggcgctttattcaccggaaatgttatggggcggagtaaatgtgcttcgttcgattttggcggtaaagataccggcggtaaagcgggccgggattcaaacatggtcaaaaaatagtgtgtgtgaaatggcgcagcgtattgcgggttatgtaaacttgcaggacgctgcgctttttgtttgaatgcgatgggccgccggcgcagcctgcgggcgattgtttggatacgatgggccgccggcgcagcctgaaaaaacgccgccttcccgttgaaacatgattctgctggctaaaataagtattatagtgtagaatgtttaatagacgggcaaaagataagtgataggagtttgaaattatgaagaatcccagatttaaaggttatatatattggggcgtgacgctgttggcggtgatcgcctgctcggtggcgttcgtattttttctgctgaagttccagatggtggcagcggcggcgggaaagctggtggacgtgctcatgcccatcatctacggcgcggtgctggcctacctcatgctgccggtttacaacaaaaccaggcgctatgtgacggagaatctgagcgttaaagtcaaaaatgagaagatggtccagagcgcggctagggggctggggactctggtgagcctgcttcttttgatcgccatcgtggtggggctgtgctggatgctgctgccccagatttataccagtatcctgggtttgcaggagagctttagcgagaacatcaacaacctgtccatttggctgcagaagcagcttgcggacaacgaggccctggaacagatggtggttccggtttacgagcaggttacggataaattggaaacctggctgtacgacaccctggtgcccaatatgtccatggtgatcaacattctctccaccggactgctgggcgtggtcacggtgttgaagaacagcctgatcggcctcattgtgatggtgtatttcctgaatatcaaggacacgctgtccgctcagtccaaaaagatcgtatacagcctgtttccactgaagcaggccaaccgcatcattgaggaggtccgcttcacccacagcgtgttcggcggatttatcaccgggaagctgctggactccttaatcatcggcgtgatctgcttcttctgcatgcgcctgctgcggatgccctacgtgctgttagtcagcgtcattatcggcgtgaccaacgtgatcccgtttttcggaccgtttatcggagccatccccagcgcctttctgattttgctggtgagtcctatgaaatgcctgtattttctgctgtttgtgctggtgctgcagcagtttgacggaaatatcctgggtcccaaaattctgggcgagtccacgggacttcccagtttctgggtgctgttttcgatcctgctcttcggcggcctgctgggatttgtgggcatggtgattgcggttcccacctttgcggtattctatcatctgacctcggagtacgtgaaccgctgtctggagaagaaggcgctgtcccaaagtacggacgactaccgggatctggattatatcgacgaggcgggcaacgagtacattgagcgcaaggaatgacggacagggaaggtgagacgttgaacatacagatttttggcagagggaaatgctttgacacaaaaaaagcccagcgctatttcaaggagcggggcgtgaaattccagtatattgatctgaaggaaaaagagatgagccgcggggagtttcgcagcgtgtgccaggccgttgggggctacggcgcgctggtggacgaacgcgcgaaggataaggacaccttggcgctccttcgatatctggcggaggaggatcgggaggaaaagctctttgagaaccagcagctgatccgcacgccggtggtgcggaatgggaaatgcgccaccgcagggtactgcccggagatatggaagggatggagctaggaaataacataaaattttgagcgcccggctggctgtcagccgggcgttttccgtgaacaggccggacgggggaagggagcataaatccatggatatcgcttgtaagaagggttgtttcttagtataatgaaaccattgaataccattttttgtaactaatgatggcagataaaggagaaggggcacgtgggagaaacgaatcggttattggaagaacttgcgctctatgaagaacaatgcggctgcttgggagagcaggccgcggaactgtcggtccggatcaaaaacgcggaatttttggacgaaaatgcggcccggtcgttcgcagaaaatttgttgggtctggttgagcggcaagtccgctgcaaggagcagttttgccgcgaaataccgggggaatggcccggctcaccggtacaggtccgtgaaaagctgaatgaggcgctgcgcatgaaaatgatggggcaggtgaaccgtttttatgcgctgtgcggagatgagcgtattggcgggaaattaaaagcggagcaggagaaactgcgtggactgctctcgccggacggcccggcgggggagctggaaaatgcgctggagccgtatgtccagtatgtgcgcgcttttgatgtcattaataagagcgcaaaagggaacgctcgcataggatatctagtaaagtgtttcggtgacgagctggtggatgcgctggcagaacaccggatacaggagcgggaggacgcgactgtggagccgcaggcgggagaaatggctgtgggaacgggaagcgctgtgaaagcgatgagcgctggtcttgtgaagcctgctgtgatggatgggagctgtgaggcggagacggccgccacggatgtggatacaggggatttagaggcggcggacgagacagaagtggacgcggtggtttgggcggaaacggtggggcttcgggaagaggaaacgctggagttggatgagccggtcgaggaaacgttggagctggacgagtcgggcgaagaaacgctggagttggacgagtcgggcgaagaaacgttggagctggaagagtcgggcgaagaaacgctggagttggacgagccggtcgagaaagttttggagctggccgaggcggtcgaggaaacgttggagctggaggagccggtcgaagaaacactggagctggaggagccggtcgaggaagttttggagctggaggagccggtcgaggaaacgttggagctggaggagccggtcgaagaaacactggagctggaggggccggtcgaggaagttttggagctggaagagccggtcgaagaaacgttggaactggaacagccagacgaagaaacactgcatccggaaacaccgggagaagaatcgctggagcggcctgcctccgagcctacctcaaaaaccgcccccgaatccgaagaatccgcccagccggccgacgacgcggcgacagcggagctcaccccccttcctgaagatctgtttcagaaaatgaaggaagccggcgtttctttcgcatcggattctcagccgtcaagctggaaatacgaggagccgaagaaccggaagaactccaagcaaagactgattttagaaaaaatgttcagactgaccaaaatgcttcgggattacggatacctggatcaggagctgattggtatgattgcgtcggatattcccaaaggtgaattgaagtatgtgattgtggagactttgaaccgtggatggatcggaagatgcgtgcatgaggggtatccggttatctatctggagtctcccctggcgccgcgcattgcgttggacatgcaaagcggagatgtgcaggtaaagatagagacatacggggaagcggccaaagatgagtgcggcgcatggaaccattatctctacgcactattacttaaatatttcatgaaaatgccggggatgcagtcaatccaggtgcaaaccggcccatattatacggtgatacagggcgaacgcgacggaaaaaccattgccgcagagattgccgcgttcccggaatctgtagagcagagcgagctggaacagtatacaagaagcgtggacgcttgcgcggccgcaaaaggagccgccgtcatacatgccgcagcaacccgggaagcggcgctgggccttggcggatggtggaagcagcgctttggctccactcagtccgaacagtacctgtttgatgcggaaacgggtaaatttgtggagcttcgaggagaaaatgcaaatggagcgccgcttacggaggttttgagaagcgttggcgcagaagtagaacttatggcaccggatgtggatcgggaaacactacaatcagaggaaaaccagccggaagtgccagggcagcaagaaattcagccggagccccccaagcatgaggaaaaccagctgagtgcgcaaaatccgcagccccagcaatctgtttccaccgtcccgcaggggcctcatcccggcgagacgccccaggcggacgcttgccccgcggaccagccttccgttacgccccagccctcccccgcagaccagccctcccccgcggacgaaaaaaccccggacaagaaaaccgctgttatagactgggagagtacataccggaatatccaggagatgctggctcaggacaaatattactgcgtatttccctatctgaccgccaagggcctgagcgacaggcagttttaccaggcgctggcttacgccttcaacgagcccacctcccggtgcgaatacacgtccacgggcattttcgacatattccagtccgaggatatgagcggagacgagttgatgcggtacctgtaccttgcggcggctctgcggaatttcttctataatcatgtggaacacgactatatgatggaaccgcttcacggcagcctccagggctttatgatcgagaacatgccgctcaatgagctgatatatgaatttaaatccttcaaacgcgaattttccaagggaatcgattactatgcggattaccgctgccgggagcgtctggaggtcgaatcgcaaattgagcgggtgacgaagcaggccgagggcttctacgaattgattcttgcccccttaaaggagagcgtgccccagaagcgcttcttaatcactcaggacctgatcttcaaacggggctccatgattgccggatggctggagagcgtgaaaaacgacgagcgggagctgcgggactaccttctggaggaggtgcaggccaaattcatcaaagacggctgcacggtctgcgagcagaacctggacccggagaaaatcaaccgctatctggatgaatgctgggacgagtccgtcaagagcatcctggcgggcaaaaagacctccgacctgatgggaaatctgcgcacaaagctgtacaaccgcatttacaagaacctggtgccggtgtgctgctggctggagctggtggaccgttccgacatcgcggagaacgacccggtgctggcggaataccgcaggaaaaaagatacctggctggggctgattgaagctgcgctggagtgcaaccgagagctggaaaagaccgcggttttaagccaggtggccggactccactgcctcgaccaggcgctgtgtgaattcaaacgcaaactgaacggcgaataccaggaggcggaacagaaatatttttatgtaaacttactgagaaacgaccaggtgctgctgaccggcggctatacgccggatttgcgggaccgctgcgaggaattgggcggattttcactggaagaacgcctgattctgcactcgaaacagcccgagcgggagtgggaagagcggctctatgaaatctttgagggtgagaacgagcagctctacgattacggctccggtgaaatgatcctggcctatctgaatgacctgggcctgagcgacgggctcaaaaccgattacgacgtgagcacctatgtgaaacgggaacgggtggatttccggtacaataactttgtggaggagctggaactggcccagagctatggcaagatttacgacaccaagcgcaaccagaagcagcatatcctttccgtctccgaggcctggtatcacgccacgctggagagccacaactatggcttctacttcaaggtgctggcccgctaccgggagaagatcgacgaggacgccagagagcagggcagcgtgcaccgcagacattttgaaaagcttctggcggagcacaaggagtatgcgggctgcccggtggccggacggattgaggaaatgctgaaggtgcagaactacacggtggccgaggacctgatccgcagactgcgggtgggggagacggagttggcggaaaatgaatttgccgcgtccgaggattacctgacccatttctgcgatacctttgacgaaaaccaccgcctggccgggacgtcggggcggacgctgaaaaatgaaattgcctccggtaagttcaagaaggatatgaaaggcgggcagctcctcatcgacaactggctggtctccggccaggagatgggcacggagaaaatgaagcggctcatgggccgtctgggcttcaatgtggagaaggttcagaagatttccgacgagaagctggaaaaatacactattctcatgaagcgtccccgaaacggcagaagaaacaactttaagcaccccattgcggtgtttggaagtctggccgcacagcagcccatccaggcctgctgcctatacggatattttgacacagaccgtctgatcgagacctgcaagagcatcggcacctccaaaaataccattgtatttctggattacaagctctctatggcggagcgccgccgtctggcgcggaagatgaagaacgagcttcccgagaaggtatttgccatcgtggaccgggtggtgctggtgtaccttgccgcaaattataacgaaaccgcggtcaacaaaatgctgatggcagtgaccatgccctatacattttaccagccctacgtgtggaaatcctccaacgacatgccggcagagctgtttatggggagaaagtgggaactggacgagatcgagtcccccaacggagccaatatcgtgtacggtggccgtcagctgggaaaatccgccctgctcaaaatggccgccaaggagatcgactgtaacgagaacggcgaccgggcggtatttattgaaatcaagaaaatgaacgtggagaagacggcggcccacgtgtcgcgggagctgatcgactgcggcgtgctggaggacggtcaggagaccagcgattgggacgagctggcacgcagcctgaagcggcggctcaacgtggaaggggagaaacggattccctacctgttgcttctgttggatgaggcggacgtgttcatcgagcgctgcgctgcggtgaattacgccccgttagacgctttaaagagcgtgcagcagatgggcgtggggcgttttaaattcgtgatcgcgggcctgcgcaacattgtgcggttcaaccgtgaggccgcgctgggcaacaacagcgtgatcccacatttcagcgccatcaccgtgaggccgtttaacgtggaggatgcgaaggaactgctggaggtcccgctgagctacctgggtctgcggttcccggacgcgtccatggaaacgctgatcctggccacgaccaactatttcccgggcctgatccagctgtactgcgcacgtttgctggaatccctcaaggaaaaggcttacgggggctacgatgagagcaacacgccgccctatctggtcaaggacaaacacatcgagaaggtgctggcggatcaggaattttccgaccagatccgggagaaatttttcatcaccctgaaggagggcgaggacaactattattacattatctgcatcctgatcgcctacctgtaccacacggagggcgcgggcgaggggtacacggcaaaacaggttcaggacctgggccgggcctttgaaatcgacaagatttcccagctccccgaggagcggctgtatgcgtttatgatggagctgtgcgagctgaacgtgctgtgcgagcaggaggaaggcggttttggctttagccgttacaatttcttccaaatgttaggaaatactctggcggacgtggagaatgagatcattggctgtatggacggagcgggaggtgtgtgatggaagagatttggtggagacaggtgaccaatgcgcgcaaattccgggaggagatacaggatgaaatcttcgatctccacagcatcgtcatacagataccggaaaaactgcagtggtacgaggagatgcaggaaatggtccgggaggaactgcacaaccgggaatcggaacggcttctggagcggatcgacgattccggggagtccatggagcccggcgagctggttttaaggcggtactgcaaggaggagcgccaggcggattatcggcccagcaaaacccacggccagtttctggccgggtgccgggatatcgtgctcaacacccggtatatctgggtgtccaatctgagctatgaacggtaccggagctggcttaaatttctcgcagactacgagcgctctgtaaagaccaagagcaagggcgtttttattctggaagtgaacgaggccgtgggagcgctgaggaaagaacgcggcgtccacaatattgtgtggaaggacatggtggggcgttacgacatcaccatgtttgctttgctattgctgtcggagtggaaaaagccggatatttacaagcagtatgtggcggagctggccgccgcgctgtccgcggacaacgcaagactctgcggcgcgctctccgaggccaggcttgagctggcggaaaatccgcaaaaatgcctggagaaacagtgcgaaaagctggatttcccgacgcccccggcggagacttcggcaaaagcggtctgggaagtgcagctgaaggtgctgtttcccatcaccgagcagttccgccagcagtttaccgggcgctacggaaaccagatcgagcggcttctgcccctccaggcggtctacggtgaggtgttcgacgagccgggcacggtggagctgggcacgttaaagtatctgtgcgatctggggaaactggccgtggcaggcgaggatttgagaaggctggtgctgttccataaaacgaggaacaccctggcccatctgcagacagtggactacccggaggtggaggaactgttgcattttgcggcgggcggggataaaaattgaggaactgacccgtggctatcgccagtgcaacggtgaggccttgggaatgtcataaagcatttggagggaacagcaatgtttaattccaaatgctttttatttaaatgcaatggggcgttggcgcagcttgtgggcgattgttattaatatcaataaaatgtttaaaaaataataaaatatgatataattatagtaatttatattaggaggcggtaatatggcattaaaagcggaaaatgtatttaaaccaggtgcatatccggaatatacttatgtatcccggaattatgaaaatactggaatatcatatgaattgcgtttaaaacaggcattgcgaacggccggctgcctcacttcgttaattggaccatcaaagatgggaaaaaccatcttatgtgaaaaagtgataggctttgacaatataattgaaatatcaggtgcagattttaatactaattctgatttttgggccatcgtagcagcaaaggttgaattgccataccagggagaagtaacgaccgagagagaactgaatgacggcaatagcagggagagtgatggaaaaaaggaaaagtacatactttccaaagataaaatcattcagtattacaaagataatgaaaaagtattggtgattgatgattttcattatgcatcgaaagagatgcagatgaaaatggcgcagcagttgaaggatgccattcgaaaagagttaaaggtcgtggtggtttctttacctcacagggcggatgatgcgatccgccaaaacgccgatttgtccggaagattaagtttaatcaatattgaaacgtggaaagagaaagatctgaaagagattgctttgatgggattcaaacaactcaatataaatattacagacgaggttgcggggcagctggcaatcgagtgtttgacctccccacaacttatgcaatacatttgcctgagtatttgtattttgttggaagacaaaaacgaagataccgtaaaagcagatatgctggaaaatgcctatcggtttacaaccgtaaactttaattattccgatgtagtgaatgtaatgtccaaaggtcccaatccacgtggaaagaagcggaaattatttaagactttaaccggaaaagaattggatttatatggactgattgttgaatcgattgcaaagaatccaccggttatggaaatggactttgaaatactgtatgatagaatcataaacctcattccagtggatgccgtaaagccggataaacagtctgtaaaaaatcatttgaacaatctacagaccatattgaaggaaaaagaggagatttacagagcgatagagtggaaagacggaactgtttatattttagatccgctatttttgttctatttgagatggggtaggattgatgagtaatttattgaagaattatgcagaggagcttaagctaatagagcgcgttgaggagtacgatgcattctgtcatagattcatacaaaatttgcttcaggaaaaatttgatagcgagataattcagaatgtcagaagcaagggaacgtatatggcaaatgagttttcggatatagcaaccagaaacaatatgttaagggcgaaagaaaatcttctcttttatttagagactacgttgttcggggatcaaggcacttattcaaaacccgatgagtgctgtcttgaaaaatacttgaattgtttctatttatttttagaggcacttaaagagcggctcccggataaaagagcctcacttactgcaaatgatttgcaagcgataaaaattgaaaatgaatatgatttgcagcatttgctatatgctgcgttgaggccgctttatgaggatatacgggaagaagtaacagaagattcaggcgtaggggctgttagaagtgatcttaaaatcccttccttgaacgctattatagaagcgaagtgttccagaaaatcaatgaatctgaagtcgctgacggaacagatagaggccgatattgtgcattacaaagctgattcaatctatttttatgtatatgataaggagaagattatcaaagacagacatgcattcgaaacttgctttaatcaaaatttcgacggaaagaaagtaagaattatcatattgcagccagttaatttgtaaaaagtttattccaaggcttagagtctatgggaagatgttgaaaataattccgtgaaaatccgtacaggatgtgctaatcctcctttcacccgcataagatgtaaaaaacatcctcagggggattcgtttgaaggagtacattgaagaacgggccgtagccatcgccaattacattatagaccacaatgcaacggtgaggcagacagcgaaaaagttcgggatctccaagtccacggtacataaggacgttaccgaccgattggagcacatcaacccgaccctggcatctcaggccagggtggttctggatgtgaataaatccgaacgccatattcgtggcggactggccacgcgtgaaaagtatcagcacagacttcagatgtgcagcaaagacgacgattaaggcgcgcccgttcaaaagggattcaaaattgaaacgaatgaggagaaagccgttccgatttggggcggcttttttgttgaatgcagtgggccgccggcgtgtcccgcggcctatcggaatgtagtgtgccgcgggcgtgtcccgcgccctaccgcctgttcagcagtcggacaaccgcgcctttgcagtcttcttcctacgatcttccaaatattcccataaatacccgcaaaaccgttccgtgttagccgcggatagttccgatggcgatttgtgtgtgagcatgtaaagcgtgcgcttgggaggcgcgggatccagctccaggattttaaccgaaaattgttccgccaggccccgggccgtggtggaaggcatgacagtccagtaatccccgatctccagaaatccggtcaggatggaaatgctggaggccgtgaccagggggcggcgggaggcgccgatataccggtcgtgccacaggcggaattcagggccccagcccacgttgctgttaaaatgggaaccggtgaacaactcccgctccggcgacagcccggtgggatcaacgggggaaatccacgggcaggactccggcgtcaccagcaccatatcatcctccatcaccggccgcacatttacgtgggggtcgtttgtgtggtagagggcgaagccaaggtccgcctgttttttggccactagggcgtagatcatgtctgcgggatagcatttgatatccagggaaaagccgtggagggagaccaggtcccggtacaggggcgtcaggttgtagtccagaaagctgtccaccgtggccacggacagatggggggagtcatccgcccggctcagctggtccgcttcgttccagagggacagcatctgggcggcgatgcgggaaaattccgtgcctttgggcgttggcacggcggccttcacccctttttttcgctcaaacagctcaaatcccagctcttcctccatagcccgcagccgggagccggcggtggatggcgacaggtataaaagcccggcggctttcaggagatttttctcctcgaaaatggtcataaaaagctgcaggtcgtcacggttcatgaaatttcccctcctggtcggaacatcaggggacggcggccgccccctatacatccagcatggagatgcggtccgcatttgccagaatgaaatcccggcggggctccacatcatttcccatgagcagggaaaaggtgcggtcggtgtctgccaggacgtctgagtccgctccgccgccggtggtcaccttcagcagcacgcggcgttccgggtccatggtggtttcccagagctgctgcgcgtccatttcccccagtcccttgtagcgctggattttgtaagtgccgtcccgttcgttttcgtccagaatgcgggacagctgtgcgtcactgtaagcataccagagtttgcgccctttttctacccggtacaggggcggttgggccaaaaaaatgtgcccgctgcggatcagctccggcatgaagcggaacaggaaggtcaaaagcagggtggtgatgtgagcgccgtccacgtcggcgtcggtcatgagaatgattttgtgatagcgcagccgttccaaagaaaagctctccagaatcccggtgccaaaggcggagatcatggctttgatctctgcattggaggaaatcctgtccatggcggccttctccacgttgaggattttgccccgcaggggcagtacggcctgattttcccggcagcgggcggccttggcggagccgcccgcggagtcaccctccacgatgaacagctcgcagctttcgggattgcggccggaacagtccgccagctttccgggcagggtgaggccggagagggcggttttccggcgggccaggtccctggcgcttttggccgcatcctttgccttgcgggccagcatggctttgctgcaaatggccttggccgcgtccgggtgctgttccagaaacaggatcatgcggtggtataccagactgtccaccgcgggtctggcctggctgctgcccagcttctgtttggtctggccctcaaactggggatcctgcatacggacgctgatgacggcggtcaggccctcggtcaactcctcgcggcagaggggaggtgcggactccttcagcagcttgagattccgcgcacagtggttcaacgcacgcaccagggcgctgtgaaagccggtcacgtgggaaccgccctccggggtggaaatattgttgacaaagctgtacaggcggtggtcgtaccccgcggtgtgctgaatggcaaactccacctgaatatccccggaatccgcgctgccgcagatgatttcgctgtaaagcggggaggcgtcccggttcagccaatttacaaaatcttccaaccctttttcgcagaggaaatggtcctggcggggaagcgtgggctgaggcagattcggggattccggggacttgggggcatcggcggttgtggcatcgggagtggcggcagtgttggaaccgtgtttgcagtccgcccgcaggtctgtcagcgtcagggacaatcctttggtgagaaatgcggtctctctcatccgttttttcagcacctcatactgaaatacagggtcccggaagatttccgggtccgggaggaacgtgacggtggttccggagacggagaccgtatccaaagcgccttgccgcgccggagaaaacggggcctcattccgcgccgaaggaaccggatcgtcctgtcgcgtcagaggaatcggatcatcctgtcgcgccaaagggccagttgcgcagccccgcaccgcctcttcctttgtcaccgccccatccggcacgccccgtgaatagctttgcttccaggtcccgccgtcccgccgcacctccacgcgaagccacagggacagtgcgttgaccacggaagcgcccacgccatggagaccgccggaaaccttgtaattgctgctgtcgaacttcccgcccgcgtggagcacggtgaagaccacctggagagcggacaggcctgtttttttctggatgcccaccgggataccccgcccattgtcggtaatggtgaccgagccgtcccggttcagggtaacggacacggcgctgcaatgtccggccagggcctcatccaccgcgttgtccacgatttcgtagaccaaatggtggagtccggcagaggacgtgttgccaatatacatggcgggccgtttgcgcactgcctccaggccttccagaatttggatctgttctgcgcggtattcatttttcaccatagtgcccacggcctcgggttgggatacggagggttcttctggtctcatagcgttacaatactccttttcagtgttgatacattgtcggcagccgcaggctgtcgatcagagctacgtttcctaattatatcaaactggccggaaaagccttgacggattttccggcataatatagcgaaaaaatggtcaaatgtccactctgccgcagtaacataaaatgggaaaacaggctgttcgtgctgtaaaactccggctcgtgcagggcttcttgcggggaggccgtgaaattgatatgatattcacatactattgaataaagaagggaaatgagtatggttaagaaaatgacttgggccgtgcggactccgcagatctgccttggatttgtacttctggtgatcggctacgttatgtttgcgatgatgaatttttcggtgttcgatgccatcaaagggccggttgagctgacagcggagatgagtttacaggagatggagggacagtatgtgtcctacgaggtcaaataccccctgggcacctacatggaggaaacggtcactaaaaaggtgaacggcgtgagcaccggtacttccagatcccgcctggggtacatcgtgtacgatgagaaccgggatgatttcctggctgtggagtgcgcggtgaagcaggaagacgagatggaagggctggtagatcagttctgggcggccctggacggtcagggtgatgttgcggagaccgggatcgtgatcaagggaagcctggagctgctcatgggcgaggatctcagatattacaaaaaaaatctgggttccgtgcttgacgaggtaccggagtcagcctatgtgattacgggtggaaagattaaaggggagaagatcggccagatctatgggatcagcgctctgggcgttgtcattgctgtgctcggaattgcattgcttgcaaaatcttcctccaaggagatcagccggagcgtagccgcctacctggccgccaaccctcagttcaaagaggaagagctggagcaggattttgcaggagcggtgaagctggggagtttatgggtcggcaagcgctggacctttggtatgctctcggataaaagtgcagttcacgacaatgattccattatttgggtttacccctactctgagcggagcggcaaaaatacaatcagcaagatgggcgtggtattcctggacggatcgtttgcttccgcaattctgtccggcgggcgcacgaaaaaagccatggcggagtacgaccgcctgggtcatatcgtgaccggaaacgacgtgtcctaccgaaatacgctggccagcgggctgagcgagttcctcgcgcttaaatattacccggccaaaggcataaacgctgccgcaacccaggagccggcgccggcgccggaaacggacccggagcaggaggcgtagcagcggacctgtaaaaaccagatcaagggcgtagctgcgcatccgtaaaacgccggatcaagggtgcaactgcggatccataaaacgccgaatcaagaatgaagctccgaaaccgagaatgttggatcaatagcgcaactgcatatccgtaaaatgccgcattcagacgcgtcccctcaatctgcaacatgcgctgcaacgcagacacatatctgaatccacaaactacataacagcaggccgcagcctctgatgaatttctcagagtccgcggcctgttcgcgtccatttgcatatcaagtccggttcttttagaatgcagttattgctttatataaactaattttccgcccgcccgcgctatttgtcccgcgccgtctccagccagctctgcgccatctcatactgttccctgttaaacgtgattttacccttgcacagggtaaaaaatccttcctccttcaactgccgtatggtccggttcaaggttttcacgttgatgccgatctcctcctgaaggagctgccgggtccggctgatggtgacctgctttggcggagcggggctgtcgatgccgtactggcggccgtattttaccatgtagtccagcaacagatacccgggcgggtaaaagagctttgcgccgttgttgtaggaggagcggtagagcttaaaagccgtgtgccggctggtgagccttaaaatgttgatgtcctcggacagccagcgctccgcgtccttgcggctgatataggccaccacgttttccgtcaccgcctcgatggtgacggaggtccggggcatcccggccagaatggtcacctccccgatgaaatcgatggccttgttgctctcgatcatatagacattcccgttttcaaattcattgatcacccggttttcgccctgggctacgatgccgaagtacccaagctccatatttttctgatggataatggaccctgcggcgtgtgtgcgcaccgtgcagcggttgcggatgtcctcaggcatataccgtgtatattccaaaagctttggaaccttgcgttccagttcggtcagcgtcatttctctccctcgattcttttgtactgcgcggtccctcccaacgcgcccctccaactgctctaagtataccatccaacaaattccaaaatcaacgtaaaatttcgtgaaaagtgctcatttgtccttttttaaaacagatgatttggctaaaatactgattacaaggtgattgtgacagtcggacggggtgaaaaataacagccggctgggaaggaggggctcttatgagcggaaagaaagaaacttatgtgtacggttcgctgcgggaacggttcgcgttggaatggaagatattcgcgctggcctttgtgttcatcctgatcgcggacaacatcgggcagatcaagatcccggtgggcaagggaatgtttatcctgttccccatattttatgccatcattctgggcgtgctcagcggaccgcaggtattaaagatcgtggataaccgccacgtgaaggcggcttccaagctggtggtggtggggatctgtccctttatcgccaagctgggaatcacggcgggggccaacatcgacaccattctcaattccggaccggcgctgcttctgcacggcttcggcaacctgctgggaccgctgctggcaatgcccatcgccatcttgctggggatgaagcgggaggccgtgggcgcctgccactccatcaaccgggaataccatatggcgctgatcaacaacatatacgggccggaatccgccgaggccagaggcagcctttccatctatatcgtgggcggcatggtgggtacgatctacttcggcctgatggcctctgtggtgggcatgaccgggtggttccatccccaggccctgggtctggcctccggcgtgggagccgggatcatgatggccagcgccagcgccagtctgtgcgccatttatccgggcagcgccgaactcatttccaccatggccagcgcgggcgagactatggcgggaatcacaggcatttacattaccatgtttatcgcaattcccctggcggataagctctaccgggttctggaaccgaagcttggaaggtttgcattaaaggaaaagaaggaggagaaagcggcatgagatacatagaatggctggtactgtttattctgggggcctgcggaacgggccttgcgaacctgatcggatacggcgtgagcttcacggactccattccgggcctgctggtgctgatcgtgatctccatgatcgccgtgtttctcaccaaggtgctgcccttaaagctgcccatcgtggcgtactgctccatcattggcctgatctcagcctgccccctttccccggtccgggagttcgtgatccaggcggccggaaacatcaacttcaccgcccccttcaccatggtgggcgcatttgccgggctggccatcagcgaccagctgaagacgtttctcagccagggatggaaaatcctgattgtaggtattttcgtgatgaccgggacatttttgggctcctgtctgtgggatcagatgattctgaccctcaccggggcgatttgatagaggaggaaataagggaatgcagaaatgtgatctgttgattaagggcgcggatgtgttgataaacagcggcgagctgagggaaaatgtggatatcgccatagcggacgggcggattctggcagtggatgcgggcctggcgcaagcgtatgaggcggacgaggtgctggacggccgttataagctgttcatgccggggctggtggacagccacatgcacaccggacagcagcttttaaaggggctggttctggacgccaagcccattatctggaccagggttatgcttccctttgagagcacgctgacgccggagaaaatgcggctttccgcccaggctgcggctctggaaatgatcaagtcgggcaccgccgggttcatcgacgcgggcagctatttcatggaggatgccgcggctgtctatgaaacgagcggtcttcggggcgcgctcagttactccaccatggacgaggagggcctgccggaatccatcgccatggacgccaatgaggcggtgaggcgcacggactccctgttcgacgccttccacggaaagggcaatctgaaggtgtattactccctgcgggcgttaaattcctgttccaaccgcctggtggagttggaggcggagcacgcccgggaccggaacaccatgcttcaggcccacatgaacgagtatatgggcgaggtcaacggcatcctggagcgggagggcatgcggccctatgagtacctggagaaaatgcaggttttgggcggcaatttcctgggcgctcacagcctgatcctaaccgatcgggagaaggagctggtccgcgaccgcggagtcaaggtctgccactgccccttcagcaactgcggtaaggcggtaccggacacgccccagcttctggaaatgggcatcccggtgggccttggcacggacggagcggcccacggcggactgagcctgtggaatgagatgaagattttccgctccgtgatgaacattatccacggcgttcccaaccgcaaccccaaggtgatgcctgcaaagaccattctgcacatggcgctggagggcggcgctgcggccctgggcgaggaagggcagctggggcgcgtggaggccgggtacaaggcggatctgatcggcatcgacatgaatcagccccacctgtgccccaccggggataagatccacacgctgctggagtgcgtgaatgccggagacgtctccgatatggtagtgggcggccgggttctgatgaagaaccggaccgtgctgaccctggacgaggagcggattctctatgagtcccgcaaatatatggaagaaatagcgcgaagctgagcggggaaatgcggatgcgggcggccatgcggaaggaatcagagctggctctccccgcatcaatagagctggctttgccggaatcaataattttttggaggaaattgtaaaatgggcttctggatgatcgtaattttggcaaacctgattgtgggcgtgctggttgggctgacgggcgtggcgggctttctgctgcccatcgtgtacaccggccccctgggcatgggcgtgccggaagggctggcgctgagctttgcggcctttatcgtttccggggccctgggtgcaatgaactacaagcgggcgggaaacctggatattccctttggaatccgcctgagcatcggcagtctggtgggggcggtgctgggagtgaagctgaacctggtgatccctgaggggcaggtgaaaatccttctgtacatggtagtgctcctgtccggcgtatccattctcctgcgcaaggacaaggtacagactgagggaggagggaaaacggggtatcagatcacggagcacctccccgccaccttggccctgggctttgtgacaggggtgatctgctccctctccggcgcaggcggcccggtgctggtgatgccgctgctggtggtgctgggagtgaacgtgcgcacggcggtggggattgcgttgttcaactcggtattcatcggcatccctgcctgcatcggctacatgacccagtgctccgccctggatctgctgcccgtgctggcggccgcgctgctggcccacggcatcggggtggtattcggcagtaaaaatgcggtgaggattaatcagatcgtcctgaaaaaggggattgcggtgttttccatattgattgcggtgtggaagctggctgtttaatggggatatggcatcgtatgaacataaaacagggtttttcacaagtccggtgagaatccaaaccgaaagagataacgaggtctttcacgcgtttcgcgtttatggtataataggagcacttgacgctgcatgtccgggaaaccggcgcacgtcgaaggcatagagatacagatgggagaggcggccccggcggcggcagtctcccatctttttgttgaatgcaatgggccgctggcgcagccccgcccccacgcccacaagggaggaagtcatggagaaagcaacaaataatcaacttcggctcagatacaccctggccttcctggccttatttgccctggaggcgtttatcgcgctgcgggtgcgggaccggtttgtgaggccgtacctgggggatgtgatggttgtctgggtggtgtactgttttgtgcgggccgtccggccgcgggggtggaagcggctgccgctttacgtgttctggtttgccgccctggtggaatggctgcaattcctgaacctttcagacctgccggtttttgccggaaatcccatcgcccgggtggtgcttggatcggtgttcgactgggcggatatcctatgctatgggaccggctgcatggtgctggcgctggcggagcagtgggcgggcaagcgcagaacgtaaaggaaaaagcaggaggagaatatggaatacaacgaatacgacaaagaagcattttttaaccagtacaagcagatgtcccgttctacggacggactgaaaggcgcgggcgagtggcacgagctgcaaaagcttctgccggatttttcgggtaaggatgtgctggatctgggctgcggtttcggctggcactgcaagtacgcggtggaccggggagccaggagggccctgggaatcgacttatccgccaatatgctggaggaggcaaaaaaacgcaatttttccgaccgcatcgaataccggcagtgcggcattctggaatatgaatatccccgggatgccttcgacgtggtgatcagctccctggctctgcactacatcgatgatttcgcggcagtctgccagggcgtgaaccgctgcctgcggcccggcgggatcttcgtgttctccgcggagcatcccattttcaccgcttatgggagccaggactggatctacggggaggacgggaagattctgcactggccggtagaccggtattttgaggaaggtcccagggacgcggtattcctgggcgaacacgtggtcaagcagcacaagaccctgaccacctatttaaacgggcttctgacccatggatttcggattcaggccgtggtggagccaaagccggatccggagatgatggaaatccccggaatggcggacgaactgcgccggcccatgatgctgttggtcagcgcggtcaggaccgattaaaaccagcaaacttaaaacagacgaagggagtcaaggcatgaagcagagagagatcggaacatcgggaatatttgccagtgaaatgtccatgggcgcatgggcaatcggagggggaacctggtggggggataacgacgacgcagagtccatccgcaccatccacgcggccctggatcaggggatcaactggatcgacacggcccgggtctatggcttcgggcacagcgaggaggtggtggggaaggctgttaaggaccgccgccacgaggtgattttatccaccaaatgcggcctgcagtggtatgacgacggcggcgagtaccatttcaccggggacggacaccaggtgcaccgggatctgcgcccccaggccatccgccgggatctggagttaagcctgaaggcgctgggaacggactacatcgacgtctattacactcattggcagtgtaaaacctacggtcttgtccccattgcggagaccatgggcgagctcatgcgcatgaaggaggagggaaagatccgggcgatcggcgcttccaacgtgcagctgcgccacctggaggagtaccggcagagcggccagctggatgtgatccaggaaaaatacagcatgctggaccggcgggtggaggaggagctgctgccctactgcgaagcgaataccgttacgctacagacctattctcccatcgagcaggggctgctcaccggcacggtgcccaacggctatgtgccgaggccgggggaggccagggagaacaagttctggtggcggccccagaccattgccatcgccaatgagatgatggacggctggcgggatctgacggatcaataccactgctccatcgccaacctggtgatcgcctggtccatgaaacgcagcccgcagttcaacattctgtgcggtgccaggaagcttcatcagattgcggagaatgtgaagtccgcaggcgttgagctgacgaacgaggatttcgcgcgcatggaggcggacgcggatcaggccattttgcgggcaaaggcgctgggctgagccggaaaaacgtctttatagtttctttatagaatctttatacggcccccggaaattttgtctatcttctttatatattctgcggttaaaattaaatcaggatatagatgagaggagggcgtactatgttatttcgcaagggtaaaaagatcgtgattgccggttccagtcaatggggggcaaggttggccggccagctctccggcaaaggctacgacgttgtggtggtggacagccggagggacgcgtttcgcaagctgccggaggattttaacggaaatcaggtggagggggacgtgaccgaccccaaagtgctggagcggtgcggcgccggaaaggccgtggcgttcattgcagccacccagaatgacaatgtaaacctgatggtgggccagatcgcccgctgtctcatggaggtcgagcacgtatacgtgatgctggaggaccagcagcgccagaaaatcatcggcggttcgggtatcaagaccatctgcccgctggaggcctcggctgaagagtgcgcgcggctggtgggcgaggcctgccggaaggaggccgtatgaagatcgcggttgccggaggccgggagacggcggattatctgaccggccttttgagagcggcggggcacaaggtggcggtaatccaggaggaccgcgccttctgcgagcacctgtccgcgaaatacgacatgtccgtgacctgcggggacccctgccgggaggatgttctggcggacgccggaatccgtggctgcggcctgtttttggcgctgctgcctgaggacgccgacaatctggaggtgtgtcagatggccaagcggctgtttgaggccaaaaagactgcctgtctggtccggaatccggccaatgtggggatttttgaaagcctgggcgtggatcatgccgtcagcccggcggggcttctggccgcatacgccggggagggctgaccggcccggcaggcatttgctggagggaaacattttatatgtctcatgattacggaaaagaagtggcgcagtttgtgggagcgtggatgaaaattgccattatctgggttttatccacgatgctggcaattctcatgagcagagcgggactgcgggcggaaaatctgctgttggtctatcttgtgggcgttctgatcagcatcgtgctgaccggcagcctgacctggggaattctctcggcgtttgtgttcgcgctgacgttcaactacctgtttacggagccgaagctgacgttccacatgtacgatgccaactacgcgatctccgtgttgattttcgtggtggtggcggtcatcgtctccactctgatggtaaaattacagcgccagatgcagatcgccaacaagaagcgtgagatcacaagcaagatcaataccattgggaacggctttctcaacgtctccggctttgacgagatcaagcgctacagcgaggagagcctggcgggcctgacgggtaagcgggtgaccgtgatgctcaaagagagcgagcgggaggaatttcccaacgcgctggccgagtggtgctacaaccagtccctcccctgcggccacggggaatgccagtttcccggggacagcgggctttacattcccatcaagaaccgggaaaagacctacggcgtgattgtgtttgactgtacggactggtccctccgggaggaggagaaggtctacgtggacacggtgatctcccagatcacccttgtgatcgagcgggagcagctgagccgggagaaggagaacaaccgcatccagatggagcgggagcgcttaaagagcacgctgctgcgcagcatctcccacgacctgcgaacgcccctgaccggcatcggcagcaatgccggtttcctgtatgacaacatcggaatcatcgaccaggacacggtccgggggatgttaaaggacatctgcaaggacacggagtggctgagcaccatggtggaaaacctgctgaatctgaccagaatccaggagggcaggctggatatcaataaaaccaaggaggtggtggacgatatcatcggctccgcggtaaagctggtgtccaagcgcgtgggaacccaccgccttaagaccaaaacgccggaggagattctgctcttttccgtggacgggcgcctgttcatccaggtgctggtgaatctgttggacaacgccttccgccattccggagagggcaccaccgtgaccatttccgcggagcgggtgggaaataacatccggttccaggtctccgacgacggcgtggggatcccggagggcaagatggcgcagatatttgacaatttctttaccaccgcctatcaggacggcgaccgccagcggggggtgggcctggggctcaccatctgcaaggccattgttgaggcacagggcgggaccatctcggccttcaacaacagcgccggtggggcgactttttcagtagaaatgccgatggaggacatgaaaggtgaatgaactgactatactggtgatcgaggacgacaaaaccattcagaactttctgaagatatccctgcagaccaaggggtataaatacattctggcggacaacggcttgtcgggtatctcctatttttacgcggacaatcccgacctgattctgctggacttagggctgccggacatcgacggcatggaggttctgcgtcaggtccgccagaaatccgaggtgcccatcatcatcgtgtccgccagaggtcaggagcgggagaaggtgtcggcgttggacgagggggcggacgattttgtgatgaagcccttcaatgcggaggaactgctggcccgaatccgggtggccctgcgccacaagggcacggtgaagaagcagatgtccgagtttgaactggactccctgaaaattgattttgagaagcgcaagatctttgtccacgggcaggaaattcatctgacgcccattgagtacaagatgatgacgctgctggtgaacaacagcggcaaggtgctgacgcaccactatattcagaaccaggtctggggctacgacactacggacgattaccagtccctgcgggtgtttatggcgaatatccggcgcaagatcgaggacgacacggctaacccgcgctttattctcacggaggtgggagtggggtaccggttcgcggacgaatagcgggaatttaagaaaaacaggaagaggaattgtctcggcagacgggacgattcctcttttgacgtttatgggatctttatgaacagcggaaagtgagcaatggaatctttatcaggggacgtgctaacataacttatcataaaacgaggaggaaaaagctatggcaatcatgtacggccttgtaggagcggccgcggtagggatactcctatacctgattataattctgctgagaggtgataaacaatgacgaatgtggctgttcagatgatcggatattgtatcatactggttctgttggcaatcccgctgggaaattacattgcaaaggtgatgaacggggaacgggtatttctctccggaatcctgcgcccggcggagcgggggatttacaggctgctgaaaatcgatgagaacgaggatatggactggaagaaatactcggtctgcacagcggtgttcagcgtgttcagcctgtttgtgctgtggtttatcctgtgcttccagaaatttctcccaatgaatccccaggggaccggcaatatgagctggcatttgggattcaacacggcggcaagcttcgccaccaacaccaactggcaggcttattccggcgagtccgctttgagctacttcagccagatggtgggactgaatttccagaacttcgtctccgccgccgtgggcattgtggtgctgttcgccctgatccgggggtttgtgcgggtgaagaaaaccggcctgggaaacttttatgcggatatgacgagaaccgtgctgtatgtgctgattcccctttccgtgatcgtttccctggtgatcgcctcacagggcacgccccagaccttcagccggtacgaggagacagagctgttagagcctgttacggtggaacatgaggacgggacggaaacagtggttacaaagcaggtgatccccctggggccggcggccagccagattgcgatcaagcagctgggaaccaacggcggcggtttcttcggaaacaactccgcgcatccctttgagaatcccacgcccctgtccaatctctttgaaatggtctcacttctgctgatcccagcggccctgtgcttcacctttggcaggaatgtgcgggataaacggcaggggatcgccattttcctggccatgttcatcctgctggcggtatcccttgccatcgtgggagcggccgagcagagcggcaccccgcagatcagccagaacggcgcggtctacacgggaaccgacgggcagtcgggcggtaacatggagggcaaggaaacgcggtttggcatcgcctcttccacgacctgggccgtgttcaccacggcggcgtccaacggctccgtcaacagtatgcacgacagctacacgcccatcggcggcatgatcccgatgctgctcatgcagctgggagaggtggtgttcggtgggacgggctgcggactctacgggatgatcgggtttgccgttctgacggtatttatcgccggattgatggtgggccggacgccggagtatctgtgcaagaagatcgaaccctttgagatgaagatggcggttttagtctgcctggccactccggtggcgatcctggtgggcagcggtatcgcggctctgcttccagcaacccacgacagcttaaacaatccgggggcccacggactttccgaggttctctacgcgttttcctccgcgggcggcaataatggttccgcttttgcgggatttaacgccaatacgccgtttttgaatgtgagcattgggctggtcatgctgttcgtgcgttttgtgcccatgtttgcaaccctggccatcgcgggcagcctggttaagaagcagaaggtggcggtcagctccggcactctgcccacccacaacgccatgttcattttcctgttgatcttcgtggtgctgctggttggggcgctgagcttcttcccggctctgtctctgggacctgtggcggaatattttgagatgattgcatagatcgcataacggaaggaatgaatcgatatgaaggaccaaaaaaataaaagtatatttgccgaccgaaacatgatgaaccgggcactgagggattcggtgctgaagctcagtcccagagtccaggtaaaaaatccggtgatgttcatggtgtttgtgtccgccatcctgaccctggcgctcttcgtgctggccctggcgggaatccgggacgcccatccgggatacatactggcgatctccattatcctgtggtttacctgcctgttcggcaactttgcggaagccatagcggagggtagaggcaaggctcaggccgacgcccttcgggcgggccgcagggacgtgacggcggcaaaaatcccctccacggaccgcaaatccgaggtgcagatggtgaaatccactaagctgcgcagaggcgatctggtgatcgtacaggcaggggagcagattcccgccgacggcgacgtggtggagggcgcggcctcggtggatgagagcgccatcaccggcgagtccgctccggtcatacgggagagcggcggcgaccgcagcgccgtgaccggcggcaccacggtgatctccgactggctggtgatcaaggtcaccagcaaccccggcgagggctttatggataagatgatcgccatggtggagggcgcttccagaaagaaaacccccaatgagctggcgctgcagatttttctggtggccctgtccattatctttgtgctggtgaccgcggctctgtactcctactccctgttttcttctgtggaaaagggaaccgtgaaccccacctccatcaccaacctggtggccctgctgatctgcctggcgcccaccaccatcggcgcgctgctttccgctatcggcatcgcgggcatgagccgtttgaaccaggccaatgtgctggccatgagcggaagggcgattgaggctgccggggacgtggacactctgctgctcgacaagaccggcaccatcaccctgggaaaccggcaggcggacgcctttatcccggtggacggggcggatgagcgggaactggcggacgccgcccagctctcctccctggcggatgagacgccggagggccgcagtatcgtggtattagccaaggagcgcttcggaatccggggccgcagcatggaggagctgaacgcggagtttgtgcccttcacggccaaaaccaggatgagcggcgtcaacatccacggttcagaaatccgcaagggcgctgcggacgcggtgaaggcttatgtaaccggccggggaggctgtttcagcaaggagtgcgaggacacggtcacccgcatcgccaatcagggcggaacgccccttgtggtggccagggacggccgggtgctgggcgtcgtggcgctgaaggatattgtgaagcagggcgtcaaggagaaatttgccgacttaaggaaaatgggaatccgcaccatcatgattaccggcgacaacccgctgaccgcggcgtccattgcggcggaagcgggagtggacgattttctggccgaggccacgcctgaggcgaagctggagatgatccgggagtaccaggcgggcggccatctggtggcgatgaccggcgacggcaccaacgacgccccggccctggcccaggcggacgtggcggtggcgatgaacaccggaacccaggcggcaaaggaagccggcaatatggtggacctggactcctcgcccaccaagctgatcgagattgtaaaaatcggcaaacagctgctgatgaccagggggtccctgaccaccttcagcatcgccaacgacgtggcaaaatatttcgccatcattccggcgctgtttatggggctttacccggggctgtccgccctcaacatcatggggcttcacagcgcccagagcgcggtgctctcggccattatctataacgcgctgatcattgtggcgctgatcccgctggcccttaagggcgtgaaataccgcgaggtgtccgccgccaaaatgctcagcggaaatctcctggtttacggtctgggcggcatcatcatcccctttgcggccataaaggccatcgatatgctgctcacggccaccggcatgattgtataggaagggaaggaagaagattatgaaaacagtaaaatcagttataccgaagatgctgggatttttcctggtcatgctggtgatcaccagtctcgtctatccggcggtcatcacggcggccgcccgggccgtgtttccggaccaggcgaccgggtccatcattgtgggaaacgatgggaaacggtatggaagcgagctgctggctcaggagtttaccggcgagaattatatgtggggcagaatcatgaacgtggataccgccacgttcatcggagaggacggagagccgctcctgtattcctgggcgtccaacaaatcgccggccggggaggagcttgaagcgctggttgcggagcgggtcaagcggcttcgggccgccaacccggaacagggggatgaaccgatccctgtggatttagtcacctgctccggcagcgggctggacccggacatctcgccggcagccgctgagtaccaggttcagcggatcgccgacgccagggggatccggccggaggacgtgcaggcggtggtcgaccgttacaccaccggcagaaccttcggtttattcggagagccgagagtcaatgtattgaaggtgaacctggcgttagatggaaaattgtaaatatttaggaaatatttccgggctgccgcggtatgcggcggctctgtagtgcgttatccagttggagaaacgtgagggcgggggagcgccgcagggaaaatcccgggcgcaaaatggtcccatgggcgggccgtatctgcccttcccacggacctggcggcggacgcagttttaaaaacagcagttttataaataagacaggggttgtgaatctatggatggcagaccggatccggaacagattttaaaaaagaattttcccaaggggtcagagagcggccacgggcggctgaaaattttcttcggctatgcggccggggtggggaaaacctatgcgatgctggaggcggcgcgggacgaggcggcggccggccgggacgtgctggccgggtatatcgaacctcacgaccggccggagaccatggccctgctctccgggctggaggtgctgccgccccggtggatcaaatacaggggaatcgagctgcgggaatttgacctggacggcgtgctgatgcgccgcccgggtctggttctggtggatgagctggcccacaccaacgtggacggctgccgccacagaaagcgctggcaggacgtgattgagcttttggaagcggggatcgacgtttttaccacagtgaacgtgcagcatctggagagccttcacgatatcgtggcttcgatcacccacgtccgggtgagcgagcgcattccggaccgcgtctttgaccaggcggaccaggtggagctggtggacatttccccggaggagctgcaaaagcgcctggaggagggaaagatttaccggaaggagcaggccgggcgggcggcggcgaacttctttacggtagaaaatctctccgcactgcgggaaatcgcgctgcgccggaccgcggaccgggtgaaccgggaggtggtccgggagcgggaggcggcgggcaaggactattacaccggggagcacgtgctggtttgtctgtctccgtcccccaccaacgccagggtgatccgcaccgccgcccgcatggccggagcgtttcgcggcgacttcacggcgattttggtggaaacctcccagatcaaacaggagaacgcgaaaatatccaaaaagatggaggcaaatatcgctttggccaaacagtttggggccaatgtgatcaccttgtacggcgaggacatcgtggagcagattgccgggtatgccaggcgcaacggcatttccaagatcgttatcgggcgcacggtgcaaaagccccatctgttctatgtgaagcccaccctgatcgaccggctgatcaagcggcttcccaatatggacatctatgtgattccggacagcaacgcgggaccgcagtcacggaaacgggaatttatggaactatttcgggtgaaaagcaagagtgattttcttaagacagccttgattctgggcgccgccaccctgttgtccgcgctgctgtaccggcttcaggccggggagatcaatgtggtgatggtctatatcatgggcgtggtgtgggtggcctacgccaccggaggcaggcgctggggcgtgacggcctctctggcctccgtggtgctgttcaacttctttttcacagaaccgcgctttaccttccaggcggatgcggcctcctatccattcacctttggggccatgctgttctgcgcgctggtgaccagcactctggccggacgcctgaagcagcaggctggaattgcggagcgggattcccggtacatgcaggtgctgctgaatgtgagccgcagcctgaggaagggcaggagcgcggaggaggtgctggaaatctgcgggaagcaggtgaaaagtctgcttggccggaatatcgtggtttacgacacagcggacggcaagctctccggccgcagaatctttgcgctggagggccaggaggaatccgccgcccagaccttctccggcagcgacgaggaagcggtggcggtctgggccttcaaaaaccggcacaaggcggggcgcaccaccgacaccctgcccggagccaaagcccggtacaccccggtctacagagggaaatccacctacgcagtgatcggtgtggagcttaaaggggacgacaccatcccgcccaatgacaaaaatgtacttaacaccatcgcggcggaggcggcggcccggctgacggagctggcgggagagtgaaggcggtggcgggacgccgggataccgggcggcggtcggggaggcccgcttcgctccttctctatttatagaagatttacggcagcggggccgtatggaatggaaaatttatgagcatccatgatatccttttattgaaagcaataggacgctagcgcagccggcgggcgattgctatagagaggaagtgatctcatggtagtgaaattgaaaatgaacctgaaagctccgctggaagcattctgcgaccgttttccgctgttctccatggtagtgatgcaggccgtgatggcggttgttttgatggcggcggtgggagccatcgcgctggcgggcggcaccgtgatctggctgttttaccgggccgtcggtctcatgtagggaaagccaaaactgaaagatcctgtaaaacgtgaaaatgtacttgaaaaatcctcgtaaactgtataaactgttaggtatacatgttcaggaaaactgaataccggcaggattggacgaggatacagacatgaagatattgtatagtaaaacgctggatggaatctgcatccggcgttgttttggtttagacggaacggtgcagattccggacagtctggcgggggagccggtcacccggctggcggcctatctgttttccggttccatggcgcgggcgctgcgggaccggggcggctttgaggagccgctgttcctctgggacagcgaggaatgctcggattttcccggtgtttccaggccggtttcgcgggaggaggcggacaccgagcgatgtgacggacttcccgctgtctgcggcgcagcgctgcgggagctgtgtctcccaaacgggttgaaggcggtgggggcctacgcgttttacggctgcgaggacctaaaaaagctgggatgtgcttccgccacaacggactggggcgcgggcgcgttcacgggctgcaccgggctcaagcggctgagcgtgcgtctctttccggggcgcaaatcctgccttaaggagattctctcggagctacgccaggccctcagggtggacttaaacgatccggccggggagccgacggcgcggcttgtatttccggagttttacgaggacgcggtggagaacacgccggcccgcatcatcatgcgggaggttcacggctgcggccatatgtaccgctactgctttgacggaggggagtttgatttttgggaatacgaccgcctgtttccctacgtccgggcccaggagccggaggaattcgtctcaaagctggccctttgccgcctctgtttcccagcgggactgaggccggaggcggaggaggaataccgggcctatatccgggaacatcccgcagcggcggcccgggctgccatggcggagcaggatgcagccatgaccgcccggctggcaaaggaggcccgggagcgcggacagctcctggcgatgatcggcgaggcggagcaggccggaaacgccgccgctctggcgctgtttatggatcgcctgcaccggcgctttaaaaacgaaggcgcagcgggaagaagatttgagctctgataaaggattcattaaaatacattcaggaggaaaatacaatgtcaaagaaaacaaatggacaggaactacaggaaaagctgacctggaagttcccgcatatcgcaaaggaggccccgcagcagatggagaaggcgtccaagttctgcgaaggctacaaggaatttttaaacggaggcaagacggagcgggagtgcgtgcgcctggcggtccgcatgctgaaaaaggcgggttacaagccttttgaccccaaggcttcctacgagccgggggacaaggtgtattacgtcaaccgtgagaagtccgttatcgccaccacattcggcaaaaagccgctgaccgacgggctgcgcatcaacggcgcgcacatcgattccccgcgcctggacttaaagcccaacccggtttacgaaaaggaggacatcgcctacttcaagacccactactacggcggaatccgcaagtaccagtgggggaccatcccgctttccatgcacggcgtgatcgtgaagaaggacggggagaaggtggagatcagcatcggcgagaaggaaggggatccggttttctgcgtgaccgatctgctgccccatctggccgccaagcagaacgaccggaagctggcggagggaatcaagggcgaggagctgaacatcgtcgtcggttccgtgccgttccaggacgaggatgtgaaagagccggtcaagcttctggcgcttcagattttaaatgaaatgtacgggattacggagcacgacttctaccgggcggagattgagatggttccggcccacaaggccgcagacgtgggttttgaccgcagcatggtgggcgcgtacggacaggacgaccgggtttgcgcgtacacggccctgctggcggagattgagacaaagaagccggcccgcaccaccgtgacaatcctggccgacaaggaagagatcggttccaacggcaacacggggctggattcggattacgtgctccactacatagaagatctggcggatcaggccggagtgaaggcacgggatgtgctgagaaattcgctctgcctgtcctccgacgtgaacgcggcctacgaccccaccttctccgacgtctacgaggcccgcaactccagctatatcaataagggctgcgtgctgaccaagtacacgggcgcaagaggaaagtccggctccaacgacgccagcgccgagaccatggccaaggtgatcggaatcatggactctgagggcgtttactggcaggctggcgagctgggcgcggtggacgcgggcggcggcggaaccatcgccaaattcgtggccggaatggatgtggacaccgtggatctgggcgtgccgatcctgtccatgcacgcgccctttgagctggcgtccaagctggacgtttacaacacctacaaggcgtttaaggcattttataagtaaatggggaacggtttaggcggtttatcttcccggcagagaaggccagtcgggaaagccgccttggcgcggcttcccgcaccaattttcccgccgtcgaaactgttctgcaaataaccttaaaatttcatgaaattcgtggaaaagcttttttttcaacggcaggtatgatataactaagtacagcgcaccgccgggggcgggcgaaatgaagggatagaaaaggaacgtttaagatgaaaaagtttgctttattatgtatctgcggggcagtggccgccgctgttttgaccggctgctcaggcagtgacaagctggctcagtataagggagtggaagtttatgtcgcttcccgggaggtatccgagggcgaggtttacgccaaggtcaaggagatcatggacgccaaccccaactacgttgaggtggaccgcccggccaaggaaggcgacatcgtcaatatcgattatgtaggcacccaggacggcgtggagtttgcagggggaaccggcgacggcgtggatctgacccttggctccaaccggtttatcgagggctttgaatccggcctgatcggaaccaagaagggcgaccacaaggttctcaacctgaccttcccggagaactacggagaggccgctctggccggccaggcggtggagttctccgttgatgtgaacgcggtgaaggagaagcaggaagcggttctggacgacgcgtttgtacagcgcgtatcccccttccagactgtggacgagttcatggcggataccaaggccgatctggagactgaaaagaaccggcagatcgatacccagaagcagcaggatgttttgagcctggtggtgaatgattccgatatgaagctgagccgcagcgaggtttccaagcgctacaaccaggagctggacaattacaccaagcaggccaaggctttcggtaccacgctgtccggcatggcccagagctacggcaccgacgaggcaggctttaagcagatgatcatggcttccgtgaagcagcagatgaagacccagaaggtgatcgacaccatcgcggcacaggagaatctggtgccggatgatgcggaccgtcaggcgttcgcggagatgaacggcacggatatcaacacgctgtcggattcctacggcgaggagaccgtggcggagctggtcaagaactacaaggtaatgaagttccttgccgacaacgcggtggaaaagaccgcaggggcagaagagggagctgaaggtgagaccgcagcggcagagaccaccccggcaaatgcaacagcagcagaagagacgactcaggcgcagacagaatcaaacgcacagtagtgcgaagttaaaaaacgcgtatcgaaagaaaaaggaggattctctcgtgcagattttaaaagacagaatacggaaagacggcaagatcaaggccggaaacgtgctgaaagtagacagctttttgaaccaccagatggacattcgcctgtttggcgagatcggtaaggaattcaaacgccgcttcgcggactctgaggtgaccaagatcctgaccatcgaggcgtccggcatcggcatcgcctgtattgtcgcccagtattttgacgtgccggtggtatttgccaagaaaacgcagaccaaaaacattgccggagaggtgtacaccaccaaggtggaatcctttacccacggcagagtgtacgatatcatcgtatccaaggaattcctgggacccgatgataaggtgttgctgatcgatgatttcctggccaacggcaaggccctggaagggctggtggccctggtcaaggactccggagccaagctcgtgggagccggaatcgtggttgaaaaaggctttcaggtgggcggcgatctgctgcgctccgagggaatccgcctggagtccctggccattgtggagagcatggacgaggacacccagaccattgtattccgcgacgacgagtgacctgcagactgacaaccggcgctactgttcacagtgactgaaaatttgaggactgatcaagtaagcatgaagaatcgcaaggcattattttttgacgtagacgggacgctgctgccagagggcacgcggcagatcccggagagtgcccggaacgcgcttaaggaagcgcgttccaacgggcatctgatctttatcaattccgggcgcacctactgcaacctggatgaagtaaaacggcagatcgaggccgacggatatctgtgcggctgcgggacccatattattgccggggaccaggtgatctaccgttattttattccccacgaggagggagtccgcctgaaacgggacatcgtggagttcggcctggacggcgttctggagggagcggagagctgctatatgcgcagccagccctcgcgctttccggagatcgagggtctgcgggccgatctgcgggaaaacggcgcgctctcgccctacaactgggatgtggattactatgagtacgacaagtgctatctggcttccgactgcctgagcgactgcgagggcctgtttgcgcggatgaaccggatggatatcatcgaccgcgggggcggtttctacgagtgcgtgccgttcggccactccaaggccaccgccattgagcgcgtgctggagtattacggtcttccgctggaggcggcttacgtctttggtgacagcagcaatgatctggccatgttcgagtacgccagcaactgtgtggtgatggagaagcacagtccggagctggaccccttcgccacgttcgtgaccaggagcgttgaggaggacgggatcgcctatgctatggagcagctgggcatcgtccgcggacaggtgtctctgtgatgaaaaaaaggacttggattatgatcgccctgatgtatgccgcggtttttctggcatgcttcggggttttacatattatggatcaaattatggagcccggaggccctgtgattgcggagagcagcgggacgccggggaacggcagcccatccgaagccgttccggccgagagccgccccgtcgccaccccgtctgcgcctgcgctgcctcaggcggaggaggactggaagccggtggatcacgggtacgagggctggaagcagcagatcgccggggcctggacgccgccggaggaaccgcagcagccctaccgcccgccccgccttgtgctggccacggacctgcattaccagagcgcggcggcggacgacggggggaaggcatttcaggaatttgtggagcacagcgacggaaaggtggttcgctacctgccggagcttttggaggcgtttttagacgaggtgatcgcagagcggccgtcggccctggtgctcagcggagatatcaccatgaacggagagaagatcaaccatcaggagctggcgcagcgcctgaagcgggtgcaggacgccgggatacaggtactgatcattccgggaaatcacgatatcaacaatcacgatgcgtcggtattttttggagatgacaggactccggcggagacggtggatgcccgtgaattctatgagatttaccgggaatacggatacgatcaggcgttcagccgggatgagaattccctgagctatgcatatgccctggacgagcggaactggatgctgatgctggattccgcccagtacgacccggtgaaccgggtggaggggaggcttaaggagagcactctcgcctggatggacgggattctggcccaggctcaggagcagggggtgtttgtgctccccgtcgcccaccacaacctgctgtatcagagccgcatgtatacgacccaatgcgcgatggagaacaatacagaggtgatcgatctgtttcagaaataccgcctgcccctgtttttcagcggtcatctgcacgtgcagcgcatacgcaaacacaaggcggagccgggagtgccggacaaggagtacggcatcctggagatcgtcacggacgcgctcagcattccgccctgccagtacggcttcctggagtggaaggaggacggcagcctggagtacgccacccgggcggtggacgtctccgcctgggcctgtgcccacggcgtggaaaatgaggacctgctgcatttcccggactggtcctaccggtatattcagaaactgatcagcgaccaaatcggaggcgtgatccggaatctgggagacgatatcatgaaatccatgtccggggtttacgccagggtctacatggattactacgcgggccggaagatcgatcagaaggcggtgcgctccagcctgggatatcagtggtgggagcggaacctgccggacagctacctgctgcgggagatcgaggccatgatggcggactctgaccgggacaacaattattatctgtgggaaggggaaccctgaggccaaatgccagacactcaggccttgaggatttcccggattttacagcgcaccaggtcaaaagccacgtcgttcattccgctgttggtgatgatgtccgcaaaggtgcgcgtgggctccacatagaggctgtgcatgggtttgacggtggtcaggtactggtccacgatattttccacatcccgtccccgctccttggtatcccgaaggatgcgccgcaggatccgctcgtccgcatccgcgtccacaaacaccttgatgtccaggagatcccggatccgtgagtcgaagagcaccaggatgccttccagtagaatgacccgtccgggttcgatgcgcatggtttccctggcgcggttgtggcggctgtagtcgtaggtggggcattcgatggtctttccggccttcaaaagctccaggtggcgcagcaagagctcggtctcaaaggcatccggatggtcgtagttgaggagcttgcgctcctcgaagggcagttcgtcgtgggcgcggtaatagttgtcatggtagatcacggtgacctgatctttgaactcatccttaagccggttggtgaaggtggatttgccggagccggtccccccggcgatgccgatgataacaggcattctatgcttcattgataaattcccccgtttctgtgaattgtttgacggtatgtccgttaatcagtatacaacagacgggggatttttggtatagaagcggtggagaaaaaatttaaaaaaattagcactcaacccttgacagtgctaataataagtgttatattacagatagaacaaagaaggaacgaaactcatagatggtttcccttccgagtttccaggaaacgagttggctgagcatagtataaacgataaaggagcgatgaattatgttaatgccgagtatttttggagagaacttgtttgatgattttatggatttcccctttggaggaaagaagatcaacaccatgatgaagaccgatatccgggatacggacagcagttatgagctggacatcgatatgcctggttttaagaaagaggacattaaggcccagctgaaggacggatatctgaccatcagcgcttccaccagcgccaacaacgacgagcaggacaaggacggacgctatatccgccgggaacgctacgcgggctcctgcagcagaagcttctatgtgggcgaaggcgtgaaggaggaggagatccgggcgaagtttgagaacggtattctcaagctctccatccccaaggtggagaacaaacctcaggttgaggaaaagaagtacattgccattgaaggctgacaacgattgatacactctccgcgggagggccggcgcgattaggcgtcggccctctttgcgcaaaaatatgaaaaaaaatgctattttatccagtaaaaaaaaggaaaacaaataaaaaatctcccagaattgtccatgacactgggggatttttccatgtccctgtcattgacaaaaaatgccggtagccgtataatccacaaggaaaccgaaaacggatcgaaaaaagggaggaattgcaatggcaagaccaaagagaaccatgaccgctgcggccaaggctgtggaggtcaaggaagaagtgaaggaagtggtcagggaagctgcgaaggctcctgcggccaaggctgaggcgaaagccgcagatcaggcccaggcaaaaaccgcggacaaggctgacgcgaaagcgaatgcgaaagcggaagtgaaagcagctcccaaggcagagagcgagaaaaccgtagtggtagagttcggcggtaagcagatcaaagcgaaggacgtgttggcccaggccgagaaggcttacgcagagtctcacccggaaacggaaatcaagaccgtggagctttacatctctccggagcagaacgcggcttactacgtggtgaacggagaagcctccgacgattttaagatcgagctgtaattcagaccggacctgaggcggctccaggctgcgaggggtccggcaaaccataataaaagagggaaaacggcgctcagaccgttttccctctttcccatatcaagagcctgtggaaagctcccccgcttacgcgtactgatacacctgtgtgtaccgtttccggtaatacagcgacagcaaagtgctgcccagctccgcgatggggatcgccagccacacgccgtccacgcccagcagggcggggagaatcaaaaggctggtgatgatcagcccgaaggtccgcacgaaggagatgacggcggagactttgccatttcccaacgccgtaaacagggcggaggaaaagatgttcagtccggagaacaaaaagcccatggcaaagaccgagaatccgtggctggccagctgccagaccatggtaccccggcgggcgaacaccgtcaccacggcatccccggcgaactgcgcgaacaaaaacaccgtcacggaggcggccaccgtaaagatcatggcggtccggtagacctgctttaactgggcatgattccggctgccgtggttgaagctgaccaccggggaaattccctgggagaagcccataaacagcgcgttcagcagaaactccgaatactggataatggtgatggccgccacgccgtcctcccccgcgaaccgcatcatggtcaggttgaacaggaaggtgatgatgcctgcggataggttggtgaccatctccgaggacccgtttaagcaggtttcacccagctctgcgccggacatgcgggggcgtacaaaccagagggaccgcttcgcacaggcaaagtagatcagcccgaacagcgccgggatcatataaccggtaaccgtggcgatggcggccccggcgattcccatccccatgggtacgatcagtatatagtccagcaccgcgttggtgattccggccgcgatggtgagaaacaacccgattcccggccgcccctccgtcacaaaatacatctgaaacagaatctgaagcatcagcgcgggcgcgaaacccagctgccagcgcaggtaggtgacgcagtcggccagaagcacgtcgctggcgcccagcatgcgggacaggggagctgcgaacagcgtgcccagaaccgccaggaccagaccgatgaccacgttcagaaaaatcacggcggtaaaggtctgcctggcctcttccggcttgccctcgcccatcttgcgcgccacgatggcgctgctgccggtggacagcataatcgccagtcccagcacgatgttgaccgccggatagacgatattgatggaggacagcgcgttggtgctgacgaaacgcgagacgaacatgccgtccacaatggtatagagggacataaacaccatcataatggtggtgggcagtgcaaacaccagcagcgacccgaaggtaaactttttcgacaatgaataactcataaaaaacactcctatatttcttgcatatttcagccgcaatcattatgatagactatagggtaacccgatagtcaagaggagatttgaaaaaaatatggaacagagaaatgaactctattttacaaccggcgaatttgcggagatcctgggggtgaaaaaacacaccctgtttcactacgacgagatcggcctgttttcaccggcggtgaaggaggaaaacggataccggtattattttgtgtggcagatggacgcctttgaggtgatccgggcgctgcagcgccttggcatgcccctgggtgagatcaaggcctacatgcaggagcgctccccggagctttttttgaaaatgatggaccagcaggagcaccagatcgaccaggagatcaaacggcttcggtccatgaagcagtttatccgccatgagaaacagaatgtgcaggaggcgctggacgtgcgcctggacgaaccctatctcgtccgccgggaggagtgctggctcctgctgtcggacgtgaagggccgggaggagcgcaagctggcagaggagatcgcccagcacgtgcgcctgcgggaacagtaccgggtaacccagagcgccgtggggaccatctgcctgggtcaggacctggatcaggggaaatacaaccggtatgtgagcgtttactccagaatcacccggcctgtgtccggtctgaagacggtccggcagcgtgccgggcggtacgtggaggtctgttaccgcggttatgaggacagtatggaaaagccttaccatttgatccgggagtacgcagagcgccggggacttcggctgggccaggagtggtacgaggactttctgctggacgagctgaccgtcaagggttacggggattatatcgtcaaggtggcggtggaggcgctgtagacagtgtacccggcttggagggattttaccggaaatattgtctcggggggaaaatacggaaatgtgggcggaaaacccatgaaaatgcggcccgaagagggaacggccggaatttgacttgcggtcatgggggaatttgcatataatagaaacgtatgtgaaccggcaccggcagatgggcatcccttgtcccgcgcgatgaagttccatggaatccatataatatggaaggaacggcctgacgcccgttagccgctgcgtgtccgtccctcgtcacttcgtctttaaaataggaattgacatttgtcccatccaatgatataaataaaaccacactaagctactatgaatagtgtggttaaacgctttaagatgctgaataagctggcgccttcagaggaatcctaagggaaacagccggctcagagcggatgaaacgtcagatccgtgcgggagagcagaatggcctcccggcggggaaccggtccaagctgataggagcccgtgctctcgctgttcatgtgcgaaatgggaaccaggcggttggccctccggggctggtcggggatgatcccgatgccctcacggacgaggtcctcgatatcccggccctcctcgtagtacccgtcgaacaccaaaaggcggtccggctccctgagtccggtgaccagaacgtagtgaccgcactcgtagatcacgcggatcacggccacgccgccctggcgcagaacgctcagaatggggctgtccgcttccaggtggacctggtcagcttccagaaattgggttttaatcgggaagtgaacggattccccgtagccattgatccaggagctgataaagcgcatggctgctgcggaggtgccgcggcggcagggatggccctgcccgtcaaagccgtccaggcagtaggccatgatacggcggatcatctcagggggaatttcctcccggtcgaacagaaaggacagcgcgttcgtcagggacgtgggtccgcagtcgaactcggttttctgataggaaaaagggactttcatgggcgcgcacctcattttcggagtaatgatgttatgaactatacaactacagcaggcctttgtcaagaagatggggccatgtgggcaaacaagcaggaggaataattatgaagatgaaccgtgggatcgcgaagcgggcgctgggattgggactggccattgtgatggcgttgtccgtgacggcgtgcggcaagaaacagtccggtgagcccggagctgcgggcggacagcaggaacagtccggcggccagcagacgcaggcggccggaggcgagaagatcgtcaacgtaggcgtcaccgacaccttaaacaccttaaatcccctgttgatggacggcggggagatcaacaaatacgctaccggcctgatgttcctgcccctgatggagctggattcggatttaaagtttgagggcatgctggcggactccatcaccgcggaggacgagcacaatttcctggtgcatatcgatgagaaagcaacttggtccgacggcaagccggtgaccgcggacgacgtgatttataccgccctgcggctgaccagcccggtgatcggcaacccggccatgatgtactacgtctttgtgggcgtcggcgacgaaggctacacggaaaagggcgcggaccacgtggaaggaatcaccaaggtggacgacaaaaccgtgcgtttcactaccaaggaccccatgtccctggtgaccttccagaactcctacgcccgctacctgatgacgctgcccaagcatgtgatcgagggcatcgcggaggaagacttaaagtccaacgagtggttcaaccatcccgacgtggtgagcggccccttccgggtgacggattttgacaaggaccactacatttcctatgaagccaacaaggactactggaagggcgctcccaagatcgaccgcttgaacatcaagatcgtggagggcagccagctctacgcgggcttaaaatccggggagatcgacgtcacccagaataccatgagcgccattcccatggaggactacgagagcatcgaggcgctggaaaacgtgaccccggtgtacggcgacccggtgaccaaccagtccgtgttcatccagaccgccaacgtgccggaccccagagtgcgccaggccatgctctgcgccatcgatcggggccgcatcctggaccagctgatgaagggccacggcgaggtgatcgacggcttcctctccagcgccagcccctacttcgacgcctccatcaccccggtgtcctatgatcccgagcgggccaaggccctgttggctgaggctggatgggattctggcaaaacccttaagttctatgtgaactccggcgacagcacctttatcaacgccgcttccgtgattgcggcccagtgggccgaggtgggaatcaaggcggatatccagacggtggacttcgccaccctgatggccaccgccacctcgcggaattacgacgtgctggccgttcagtacacttacgcgccggtggacccctatgcggatatcaactggctgatcaatatggaagacagctggaccagctatgtaaacgcggacgtaaacgacgccctttccaaggtccaggtgaccaacgacaccgccgagaccgcaaagctttactccatcgtggacaaaaaggtgcaggaggacgttcccatgttctccgcctatgtgatcagctccctgggagcggtgaacaagcgtctgaccggagtgcagccctcagtctacgggttcttcaaccacgtggagcagtggaatgtaaaatgatcctggcggccggctgcgacaaacgaacaaggtagcgaacctgtactcccggaaagcgccccctgcggacgctttctgggtgtccttgtttgaaggcaatgactgaaactcagaaaggaaacaacatgtcccatatcctggaagtagaaggactcacaactgtatttgacggtgacggcggccagatgaccagcgccgacggcatcagcttttatgtggatcccggagagatcgtctgtatcgtgggcgagtccggctgtggaaagagcgtcacctccctgtccctcatgagcctgctgggccggggcggcaaggtgagagccggaaaggccctgttcgagggccgggatctgctgagtatgtcggagaaggagctggacaagatccgcggcgacgccgtgactatgattttccaggacccgctgacctccttaaaccctgtgttcaccatcgggcggcagatcacggagagcatccgcgtccacatgcatctggacaaggaggcggcattcaagcgggccgtctccctgctggagaaggtggggatgccggacgccgcctcggtgatgaaaaaatacccccatttgctctcaggcggccagcgccagcgggtgatgatcgccatggccttgtcctgccggcccaggcttctgatcgcggacgagccgacgacggctctggacgtgaccatccaggcgcagatcatgcagctcttgaaggaactgcagaaggatctggggatggcggtgatcctgattacccacgatatcggcctggtggcgcagatggcggaccgggtgctggtgatgtacgcgggacagatcatcgagcaggccccggtgctgaggctgttcgacgagccgggccatccctatacccaggcgctgctgcgctccgtgccctccattccgcgtttcagtggaagccgggaagaggttttggcggcccaggaggcggacggaaaacggctggagtccatacagggcgtggtgcccgagcactacgaccggattacgggctgccgctttgcggaccgctgcccctacgaggaggagcgctgccatgaaccccaggaggaagtggcctgcggcccggcccatgtggcgcggtgctggaagaccgcctgtccggaacaaacggacggaatgaaccaggagaaggagggataagggatgaattcggaacagaaccatgggggcgggaccgggattaagccggaccgtcccgtcgatcccgcctcccggacgcccatcctgaccgtggagcggttgaaaaaatattatccggtcaagggcggcgtgatcacccacaaaatcggtgacgtgcgcgcggtggacggcgtcagctttacggtataccagggggagaccctggggctggtgggcgagtccggctgcggcaagtccaccctggggcggcagatcgtggccctggagcggcccaccgccgggaagatcctctaccgtggcgtggacctggcctccatgaaccgcagggagatggcgggaatccgaacggagctgcagatggtgtttcaggactcctactcctccttaaacccgcgcaagcacatctatgagattctctcagagccgatgctctaccacagcctggcaacgaaggataacctggacgcagagctgaaacggcttttggacatggtgggcctgcccgcccactccctgggacgttatccccacgaattttccggggggcagcgccagcgcatcggcatcgccagggcgctgtccctgcgcccgaagctcatggtctgcgacgagccggtcagcgccctggacgtgtccatccaggcgcagattttaaacctgctgcgggatttgcagaaggagctggacttaacctgtatcttcatcggccacgggctgggcgcggtgaactacgtcagcgaccgcatcgcggtcatgtatctgggcaagattgtggaattggccgacgccagggagctgttcgccgatcccattcatccctactcaaaggcgctgttcagagcggtgcccatcccggaccccagagccagggagacggagattccggtgctccagggggagattgccagcaacacccgcccgccgtcgggctgccgcttccatccgcgctgtccctacgccaggcaggaatgttctgagatcgagccggagctgaaaccggcttttgcgggcagcggccatctggtggcctgcccggtgctggccggggaagagaacgaaaaaggaggcggtcctacctatgggtaaatacattttaaaacgcattctgatcgccattcccacgctgatcggaatcaccattatcgattacgccatcatgtgcatggcgggaaatcccctggagatgcttcagggcgcccggatctcccaggcagccatcgaggcccagaaggccgcgctggggctggatcagcccttctatatccagtatttcgtgtggttgtccaacctgcttcagggcaacatgggctattccgtcaagacctaccagtccgtcagcgccatgatcggaagccatctggggccgaccctgctgctcatgggcgtatccctgatcgtcagcctgctgatggcggtgcccgccgggatttacagcgccatccaccagtattccaagggggattacacagtggtgaccctctccttcttcggaagcagtatcccgggctttttcctgtcactgctgctggtgtatttgtttaccgtcaagctgggctggctgccctccggcggcatgaccaccctgggctcctccgggggcgccgcggacatcgcggcccacatggtgatgccggtgatcgtgctgtccgtgtccatggcgggcaccaacatccgctacatccgcagcgcggttttggaaattctgcagcaggattacctgcgcacggccagggccaagggcctgggacgccgccgggtggtgaaccagcacgccctgcgcaacgccatggtgcccatcgtcacggtgatcggtatggagattcccgtgctgttcggcggggcggtgatcgtggaacagctgttttcctggcccggcctggggctaatgaccatgagcgccatcatgagccgggattacccggtgatcatgggcgtatgcctgttgtccgcggtggtagtgctggcgggcaatctgattacggatattctgtacgcggtggtgaaccccaccatccagtatcaataggagcggcccatgaagagacaaacggatattacaaatgaaagctatttacagacggtatggcggcgcttcaaacaccaccatctgggtgtcgccagcctgatcctgctgagcgtgatctgccttgccgccgtgctggccccgctcatcgcgccccacgacccggacgccatcgtaggacccttcagcgaggcgcccagcctgcgcttctggctggggacggaccagatcggccgcgacatgttgagccgcctgctctacgccacccgcatttcccttctggtcggccttctggccaccgccatctccaccgccgtgggcgtggtgctggggcttctggccgggtatttcgggggctggctggacatgctgatcatgcgcttcaccgacatggtgatgtcgttcccctacattctcctggtgctggtggcggccgccatctttgagcctggactgtggagcatcattctgatcctgggctttgtggactggcccggaatcgcccgcctggtgcggggaaatgtgctcagcctgcgggagaccaactttgtcaagggcgacattgtggcgggtatgcccctgcggcacatcctgttttcggagattctgcccaacaccgtggcccccattctggtctacgccacctcggtcatggccctgtccatgctggacgaggcgtccttaagctttttgggtatgggcgtgcagcccccgacggccagtctgggcaacatgctcaacagcgcccagtccctgaccgtgctcacaaagcagccctggctgtggattccgccgggcctgctgatcgtgatcctggtggtggccatcaactttgtgggcgacgccctgcgggacgcggtggacccaacggccaccctgcggcggtaggccgaaacagcccgggcacccgtttccctgccgtctgaactgtcacaagaaacgaggtatttgccatgatatacattgagaaaaaccacgcgattcacaccttttccccggagcaccccccggtcagccgggcgcggtccggggagagtgtaacctttgagacctacgactgctacaaaggccagctgctgcccggggacaccacctttgcggatttggaccgcggcctggaaaatcccgccaccggccctctgttcgtggaggaagcagcgccgggggatgtgctgcgagtggatatcctggacatttccctggacccggtggggattctggacatgggtcccgccagcggcgcgttgaagcacaaaatttccactaccgtgatccgccgcgtgccggttcaggatagccggatccattacaggaatctggagataccggccagacccatggtgggcgtgatcggcgtagcgccggagcgcggagctgtcagtacgatgacgcccatgaatcacggcggaaatatggactgcacccgcatcgaggccggctgctccctgtatctgccggtgaaggcgcccggagctctgctcgcaatgggcgatctgcacgccattatgggggacggtgaggtgggcaactgcggcgtggagatcggaggacgggttaccgtgcgggtacacgttctcaaagggctggccctggaatatcccatgatccgcaattcgcagaaatggatcactgtcgcgtacggcgaaacgctggatgaagccggggacaaagcggttctgcagatgttttccttcctcacggagcacgcgggggcggacccggtggacgcgggcatgtaccttgacatgctgggcgacctggcggtctgccagatcgtcaatccaatgaaaaccgtgcgccttgagctgccccgtttggttacggaggcggagggctttaccggctttgcccaggaggacggcctatgaccatacaccagatcgagtgttttctggaagtggcgcacacgctgaattttaccgaggcggccagccatctctacatttcccagcaggggctgagccgacagatatcctccctggagagagagctggagatgcggctgtttgagcggaccacccgggaggtgcgtctgacccgcagcggggagattctgctgtggaaatggcagaatatcccatccctgatccgggagtcggtggatatggcccgggaggacaacaagcgggagaaagaccgcatacacgtggcgattctgaaaatgaacggcgtgatggacgtggtggggcggatcctgacggagtacagcgaccgttttccccagacggagttccagctcaaggagtacagcgacgtgaaggacctggccgggatcaacacgccggacctgatcattaccttgagcaacgggttcgactacaccaagatcaaggacaagttcaactgggcggagctgcacagctttcccctgtactacgtgttttccaaaaaaaatccaatggcctgcatggagcgcctcagcagcgccctgcttcagcagcagacgcttctggccgtgttccggtacgaggagtccggcatcggtatgaaaatcctggaatttttgggaaatctggggtatcttcctaaaaaggtgcgctactttgacaatacggacagcctggagctggccttaaacgccaacgaggggatccacatcggctaccgggaatattaccacgactttggggaccggctggctatgtttccgattcccaccccggaaaatcaggcggaggccaaggtgatggcgctgtggcgggtagaggacgaggaaaaactaaaaaatcttgtttcatacttgaattccattgatctgcgcaaacgggaatgaaaacaaaaagatggacaattaacatcatatagttgttaattgtccgttttttgatgttagacaataaaggcatatatgtctaaaatacaaatggttggtttgtaacgaaatgggggagagctgttgcctggcaacggttgattccccttgtttttttaacgaaacaaggaatacaaagcagaaaggaaagaggagaagatgaaaaaaggagtgaaacgtgcaatttgggcggttgtgatcgtggtcatagccgtgttcctgtttttgcgcctgacaaagaagacggaattcgcagaggctacggcggacccggtggtgacggttgagaaaccgcacatgggcgacgtgcgtctgtccacccagctgatcggcaccatcgagccggcggatgtggtatacattttccccaaggtcggaggcgatatcaccgcggtgaacatcaaggccggggataccgtgacggcgggacaggtgctggtggagatcgacaccaagcaggtggatgcggtcaggacctccatggaggcggccaaggtgtccgcggagagcgcgcagaacgtgttgaaccgcatgacccccctgtatcaggccggttacatatccgcccaggactacgacggctacaaggcccaggcggacgcagccagacttcagtatgaagcggcgcagatcaattacaacaatcagctggaattcagcaacgttaccagccccataagcggccgggtggagcagtgcaatgtggagcttcacgacacggtcggccagtccacccagctctgcgtgatcgcgggtgagaacggcaaggtggtttccttctataccactgagaaggtgaaaaacaatctgaacccaggagatcccgtggttctcaacaaggacggcgtggattacaacggaaccatcaccgaggtcagcaacatggcggatgcgggcgtgggcctgttcaaggtcaaggcctccgtggacgacaacaataccatgacaccgggaacggacgtggagcttgaggttcccaaggattccgctctgaacgccatgctggtgcccacccacagcgtgtactaccgcggcggggacgcatttgtctacacctacgatgccggtgagagcgtgatccgggaggtgccggtggaagtgggaatctttgatactgagaatattgtgatcaagtccggcctgaccatggacgatcaggtacttaccacctggacttccgagctgaaggacggctacaaagtgtcgctggcggacggcgaggcggctgccgaagcgaaccaggcagaagctgcggctgagtaaggagggcgtaaaactatgggtttaacaaaactagtcctgaaacggccggtgaccacggtactgatgatcctgtgcctggtggtgttcggtcttcaggccttcatgtcatcgcctcttgagctgatgccggaaatgaacatgtccatgatcgtcgtgatgacgccctatcccggcgccagccccgaggacgtgaacgatctggtcaccaagacggtggaggatcaggtgggaaccttgagcggtctggacaccgtatcctccatgtcccgtgagaacgtgtccatcaccatgctggaatacaagtacggcaccgatatggataaggcttacgacgatctgaaaaagcagatggatctggccaaggtcagcatgccggacgaggtggaagatcccatcatgctggagctgaacgccaacctgatggccaacatgatcctggcggtcagcaaggacaacaccgataacctctataactatgtaaacgacgacgtggtgccggagctggagaagctgtcctccgtggcggaggtatccatcaacggcggcagccaggagtacatccgcgtggagctgcttcccgagaagatgagccagtacggcgtgagcatgaactccatcgcaacggacatcggcagcgccgatctggcttacccggccggcaacgccgatctgggcgaccagcagctggccgtgtccacggaccagaaattcgacaccctggagacgcttcaggatatcccgctgacggtttccgggaagaacaccatctatctgggcgatgtggccaatatttacctgggtgaggatgacactaccagtattgcccgctataacggtcaggacacgatcgcggtttccgtgaccaagcagcaggatgcggcctccctcaccctgtcctccgacgtcaacgatgtgattgaggagttaacggctgcggatccggacctgaacgttacggtggttatggataccaaggacaacatcatgtcctccctgacctccgtgttccagaccatgatcgccgcgattgtgatttccatggccatcatctggctgttcttcggcgacatcaaggcatccctgatcgtcggaagctccatcccggtatccatcctggcctcctttgtgctgatgaacctcatgggcttctccctgaacgtgatcaccctcagcgccctggtgctgggtgtcggcatgatggtggataactccacggttgtgctggagagctgcttcagggccaccacggacacgggcttcagggaattttccaaggcggccttaaacggtaccggcgtggtgtaccagtcggttgtgggttccacgctgaccacctgcgtggtgttcctgcccctggcaatgttgagcggtatgaccggcgagatgttccgccccctgggcttcaccatcgtgttctgtatggtggcgtccctgatttcggctatcaccgtggttccgctgtgctacatgaactataagccggtggaaaaaaagacggctcccctgtcccgcccggtggaaaagatgcagcaggaataccgcagaatcatgagacgtttcctgcggcacaaagggctggttatgctctcctccgtggcgctgctggcgctgtccatcgtgctggccatgaacctgagaaccgagctgatgggcgaggacgacatgggtcagattacggtggaggtggagaccaaaccgggtctgcagcttggaattgtggaagatattttgaaccaggttgaggaggttgtgagcgccgaccccaatgtggaggattacctgacccagtcgggcggcggcggcctgagcagcagcatgagctccaaccccacggtttccgcctatctgaaaaaggaccgggatatggaaactgacgacgtggtaaagctctggagaaaagagctggagagcatacccaactgtaacatcacggtcagcgcaaactcgaccatcggttccatgatgggaaccagcgacacctaccaggtgattctgcagagcaccaactacgatgcgctcaaagcggacagcgacaggatcgtttcggcgctggatgcgcgctctgaggtgaccaaggtgcactccgacctggagaacgcagccccggtggtgaaggtgcgcgtcaaccccatcaaggccaaggcggcagggctgtccgccgcacagatcggcggcaccttaaacagcatgttaagcggcgtgaaccccgcatctctggagatcgacggccgcgacgtggatattaaggttgaatataataaagaccggtataagactcttgctcaggttcagaatatcgtacttcagacgcccaccggaggagcggttgcgctgacggacgtggcggacctggtgtttgaggacagcccggccacgatccggcgtcaggataagcagtaccgcgtgaccatcaccggcacctataccgacaaggcgacggagactacggagaaacagcttcagacagaggttgtgacgccgcagctgagccagggcgtttccattgccatgaacagcatgcagaagtccatgcagaaggagttcaccaacctgggcaaggccattgcgatggcgattttcctggtattcgtcgtgatggcgtgccagttcgagtcacctaagttctcaatcatggttatgaccaccgtgcccttctgtctgatcggcgcattcggtctgctgtggattgtggacagcgccatcagcatgacctccctgctgggcttcctgatgctggtcggtacagttgttaacaacggtattctgtatgtggatacggtgaaccagtaccgccagagcatggatatggagacggctctgatcgaggcgggtgcaacccgactgcgtcccatcctgatgaccaccctgaccacggtgctgtccatgctgcccatggcgctggcgctgggcgattcgggcgagaccacccagggtctggctctggtaaacatcggcggcctgacggcctccaccattctggcgctgctcatgctgcccgcttactacagcgtgatgaaccgcggcggaaaacagagtctgatggcggattaagccaaattttaatagagggaccagatgcgtgccgcacccggcccctctttcttttaaaaagtatgtcaaaaaatagacaaacaaaaactttttgtctatctaaaaaatatttatgaaataattagaaattgcattgaaaataaaatgacgatgaggtataatctattcatattgtacaaaaaataagagaatcctgaaaaatatgaagaatttgttcgctgccttatggcagggggttcttttgagagaggaggatggagttggcccaggagatcattgacgcaatccgtcaggcggaacaggcggcggaacagcgggaagcccaggcggggcagcaggcggaagagattattgcggaagcaaggtcgggtgcggctgcgcagaagagcgagctgattcgccaggcccgggaaaaagccgcacagacggaagacgccgccaaggcccaggcggaccgtattatggcggacgccgaacaggcagaaggcgctgagcttgagtcactgcgaagcgcggtaacagagaagtcagatcaggcagtaaaagcggtattggctgaactgctgtagaaaggaggcgcgtaagattggcagtagtgcctatgaagaaagtgctgatctgtggcctcaaaaaggaccgcaaacagatcctggagctgttgcagcgccagggagctgtggagatcacgagcgggctggaggaagacagcatattcagaaagactgacgtttcctcttccaagacagtattcgagcgcaacgccgccgtagcggagcaggcattgtccgtgctcgcggagtatgcgcctgagaagaaggggcttttggccggcttcgaggggcgcgagacgctgtcattggaggagtacgagtccagcgccggcaagcatgacgagattatgaagaccgcctatcgcttgcaggaactggagaaggagattgccgagaacaagggcatgatccccaaactggagcagcagatcgatgctctggaaccgtggaaaaatttcgatctcccgctggattaccgggggacgaggaagaccgccgcgtttatcggctcgctggccggggacatcaccctggagaaagtgcacgagcttttggggcagtacgcgccccaggtggaatccgtggatgtcacgggaatcggcggaaccgcggaacagatctgtctgttcatcgtctgccaccgggcggacgcggaggcggtggaggatgcgctccacaagatgaatttttccaggccgcccctgtcccatgaggttccggctaagaagcagaaggagctggaggagaagatccgccaggtgaacgctgcggtggagaacgccaaggccgaggtggtcgggcttgccggccaggcggggcagatccgttttgtcatggactattacaccatgcgtgccgagaagtacggcgtgcttggcggtttggttcagtcacggcgcgtatttcttgtcacggggtatatttccgtgccggaagcgccaaagcttcaaaaggccctggagtcgcgctacgacgtggtggtggaacttaccgaaccatccgacggggacgacgtgccggtgatcctgcacaacaacaagttcgtcgagccggtggagagcgtggtggagagctacagcctgccgggcaaaggcgagatggatccgtccggcgccgtggccatgttctactacgtactgttcggcctgatgctctcggatgcggcctacggcctgatcatgatcatcggctgtacctattgtctgaaaaaaatcaaaaaccttgaacccggattccggaagatgttaaagatgtttctctactgcggcatttccaccaccttctggggcttcatgttcggcagcttcttcggggatgcggtgaacgtaatcgccaccaccttcttcggacggccggatatccggctggcgccgctctggtttgagccggtgagcctgcccatgaagatgctggtgttcgcctttgcacttggtatcctgcacctgttcacaggtcttggaatcaagctgtacagctgtgtgaagggcggcagcgtgacggatgcgctttacgatgcgggattctggtacatgctggtgggcggagcgatcctctatctgctgacaatgcccatgtttaccgatatgctgggcctgagctttgtggtgcccgcggccgtgggcaacgtatgcgccgtgctggcggtgatcggcgcggtgggtattattctcaccagcggcagagagtccaaaaactggttcaagcggatcttgaaggggctttacggcgtttacggcgtaacctcttacctgagcgacatactgtcctactccagactgctggcgttgggactggcgaccagtgttatctccacagtgtttaacaagatgggaagcatgctcggaggaaatgttttcggagcgattgtatttatcctggtgttcttaataggccacagcctgaacctggcgatcaacgccctgggcgcctacgtgcacaccaaccgtctgcagtttgtagagttttttggaaagttttatgagggcggcggaaggaaatttgagccttttgccattcacacgaaatattataaagtcaaggaggacatttaactatgggaaatctcggaattgtatttgcacttacaggggcagcgctggcagcacttttagcaggaattggttccgcaatcggagtgggtatcgcgggtgaggccgccgcaggcgttatcacggaagaccccaacaagttcagtaaagttctggttctgcagcttctgcccggtacgcagggtatttacggcctgctgatcggtttcatcaccctgactcagatcggtatcatgggcggcgatcccaacgtttccgtagccaagggtctgttatatctggcagcctgccttcccatggcgtttgtgggcctgtggtccgcgatgaagcagggcaaggcctccgtggcaagtatcggcctggtcgcaaagcgtccggagcagttcggtaaagccatgatcttcccggcaatggttgagacctacgccatcctggctcttctgatctccatcctgtccatcttcggcatcggcggactggcaatttaagtctacagtcggcggaagaatgaacataacgggaaaggagaacaacgcatggcgggattagacaagattatcgcccggattcaggcagagtctgaggaagcggcggcccgtactctggaggcggcgaaggccgaggcggaagcgattctccagaacgccagggaggaagcggccgcagagtgcgctgccatcggcagaaaagcggaacaggccgcggccaatatcctggatcggggccattctgcggcggagctgaaaaagcggcagagaatcctggccgagaaacaggtattgataggcagaattatcggtgaagcaaaacagcaactgaaaaatatgcccaaggaggcgtattttgaaaatatcgtgaagctggcggtgaaggcaagccagagtggcaaggggaccatcctgttctcgaaggccgatctggaccgccttccggagaatttcgcggataccttaaacgcagcgcttgttgcgggcggcaaagagggagcggcgttgactgtctccggcgagacgcgggacattgacggcggcttcgtgctcacatacggcggcatcgaggagaactgctccttcgacgcgctgtttgattccgcgcacgagatgctgcaggataaggttcaggagattctgttcggcacggtttagcgggaggtttatgaatggcaaaagatcaatatgtttatgcggtggcccgcatccgttccaaagagctctccctgctttccggttcagttattgagcagctcctgggggcgaaggggtacgacgagtgccttcagcttctccgggaaaagaactggggcgacagcgacgccggggacgccggggccatcctggcggcggaacgggagaaaacctggcagctcatcggcgagctggtgaaggacctctccgtgttcgacgtgttcctgtacgccaatgattaccacaatctgaaggcggcgatcaaggaggcccggatggacagcgagtatccggggatctacatcgaccaggggaccgtggatgtgaagcgcatccgggaagccatccgcaccagggattttgcagcgcttccggaagccatggcagagcccgcgaaggaggcctacgaggtgctgcttcagaccggcgacggccagctctgcgatatcatcatcgaccgggcggccctaaacgccatctaccaggcgggcaaggccgtgggggacgagtgcctgaagctctacggcgagttgacggtggcctccgctgatatcaagacggcggtgcgcgctgcgcgtaccggcaaggacaaagcatttttagcgcgggctctggccccctgcgacacgctggacgtgagccgtctggcccaggcagcggtggagggcgtggacgccatctgcgcatatctggaactcacgccctacgcggaggcggtggaggagcttcacaagtcgccctcggccttcgagcggtggtgtgacaacctgctgatccgaaagatccgcccccagagattcaaccccttcgggctgggacctctggcagcgtatattctggcgcgggacaatgaaatcaagacagtacggatcgtgctttccggcaagcttaaccaccttccggaagaatccatccgggaaagggtaagggagatgtatgtataagattgcagttatgggcgaccgcgacagcatctacggattcgcggcccttggccttgagccgtttcccttcactgatccggcggatgcgggaaagaaaatgaggcagctggccgagagcggctatgcggtgatctacatcaccgaggctttggcggcccagctgggttcggagatcgagcgctaccgggaggcggatctcccggccatcatcctcatcccgggcgtgtccggcaatacgggacagggcatcctggcggtgaagaaatccgtggagcaggcggtaggttcggatattatattcaacaactagtggaggtagaaaatgagcaaaggcgtgattaaaaaagtagccggtccgctggttatcgctgaaggcatgcgcgacgccaacatgttcgacgtggtgcgcgtgagcgagcagcggctgattggcgaaattatagagattcacggtgataaggcttccgtccaggtatacgaggagacgtccggcctgggcccgggcgagcccgtagagtccaccggcgttcccatgagcgtggaactgggccccggcctgatcggaagtatttacgacggaatccagcgtcccctggacgccatcatggaggtgaccggcggcaatctgttgaaccgcggtgttgaggttccctccttaaagagagacaagaagtgggagtttgtgcccaccgcccaggtcggcgacaaggtgaccggcggcgacatcatcggtacggtccaggagaccgacgtggtgcagcagaagatcatgatccccgtgggcgttgcaggcaccatcacctatatcagcgccggcgagtacacggtgaccgccacggttgcggtggtgaccgacgaccggggcgaggagcatcccatcggcctcatgcagaagtggccggtgcgccgcgggcgtccctacaagaccaagctgtccccggatatgcctctggtaaccgggcagcgcgtgatcgacacattgttccccatcgccaagggcggcgttgcggcggttcccggacccttcggttccggtaagaccgtggtgcagcaccagctggcaaaatgggcggatgcggatatcgtggtatacatcggctgcggcgagcgcggaaacgagatgaccgacgttttgaacgagttcccggagctgaaggaccccaagaccggcaagagcctgatggagcggacggtgctgatcgccaacacctccgacatgcccgttgcggcccgtgaggcttccatctataccggtatcaccatcgcagagtatttccgcgatatgggttattccgtggccctgatggccgactccacctcccgctgggccgaggctctgcgtgagatgagcggacgtctggaggagatgcccggcgaggagggctaccccgcgtacctgggttcccgtctggcgcagttctacgagcgcgccggccgcgtgatctccctgggcagcgagggcagagagggcgcgctgtccgtaatcggagccgtgtcccccgcaggcggagatatctccgagcctgtaacccaggccaccctgcgaatcgtaaaagtattctggagtctggactccaacctggcctacaagcgccatttcccggcagtgaactggctgaccagctattccctgtacgtggacaccatggagaaatggttcaacgccgaagtggagagcgactggaccgagctgcgcggacgcctgatgctgttgcttcaggaagaggcggagctggatgagatcgtgaagttagtcggtatggacgctctgtccgcgcctgaccgcctgaagctggaggcggcccgctccatccgcgaggacttcctgcatcaggacgccttccacgaggtggacaccttcacatccttaaagaaacagcacatgatgatgatgctggtgctggcatactacgatcaggcaggcgaagctctgaacaagggcgtaaacatcgagcgcctggtgaacctgccggtccgcgagaccatcggacgtttcaaatacacccccgagggcgagctggataaagcatacgacaacattctcgacacgctgcgcattgagatcggcgacgagctgagcagaaaggaggacttctaatgcctaaagaatacaggacaatcgaagaggttgctggtccccttatgctggtacgcggcgttcagggcgtaacctacgatgaattgggagaaatcgagctggcaagcggtgagaagcgccgctgtaaagttctggaaattgacggtggaaacgcgctggtacagctgttcgaatcctccaccggtatcaacctggattccagtaaggtccgtttcctgggccgtaccatggagctgggtgtatccgaggatatgttgagccgtatcttcgacggactgggccgtcccatcgacggaggccccgacattctgccggagaagcgcatggacatcaacggcctgcccatgaacccggcggccagaaactacccccaggagttcatccagaccggcgtctccgccatcgacggactgaacaccctggtaagaggacagaagctgccgatcttctcggcgtccggtctgccccacgccaacttagcggcgcagatcgcccgtcaggctaaggtgcgcggcaccagcgatcccttcgccgtggtgttcgccgcaatgggtattacctttgaggaagccaacttcttcatggagagcttcaaggagacgggcgcaatcgaccgcagcgtcatgttcatcaacctggcaaacgaccccgcggtagagcgtatcgccaccccgcgtatggctctgaccgcggccgagtatctggcctttgagaagaacatgcacgtgctggtgattctgaccgacattaccaactacgccgacgcactgcgcgaggtatccgcagcccgaaaagaggttccgggacgccgcggctaccctggctacatgtataccgacctggcctccttatacgagcgcgcaggccgtcagaagggcaagaacggttccatcaccatgatcccgatcctgtccatgcccgaggacgacaagacccatcccatccccgacctgaccggatacatcaccgagggccagatcatcctgagccgcgagctgtaccgcaagggcgtgaccccgcccatcgacgtgctgcccagcctgtcccgtctgaaggataaagggatcggcgagggcaagaccagagcggaccatgccaacgtgatgaaccagctgtttgcggcttacgcaagaggtaaggacgccaaggagctgatggttatcctgggcgaggcggctctgaccgatatggataagctatacgccaagttcgccgacgcctttgagaaggagtacgtgtcccaggggtactacgcgaaccgcgatatcgaggagaccatggagattggttggaaattgctgcgtattctgccgagaaccgagcttaagcgtatcaaggacacctatctggatctgtactacgacgagaagtaaccggtgaactcgtaacgaaaggaagttgacagagtatggctgcaaaacatgtgaaccctacgcgtatggagcttacgcgcctgaagaaaaagctgaccacagccgtgcgcggccataagcttttgaaggataagcgggatgagctgatgcgtcagtttctggagctggtgcgggagaacaaggcgctgcgggagaaggtggaggccggcatcgcggctgcgaaccagaactttgttctggcccgctccggcatgacggacgaggcgttaaacgtagccctgatggcccccaagcaggaggtctatctggagtccgagaccagaaacgtcatgagcgtggagatcccggtgttccactacaagaccaggacctcggatgccaacgacatctactcctacggatttgcgtttacttccagcgatctggacgatgcggtgaaaagcctggcggaccttctgccggatatgctgcgcctggcggagattgagaagtcctgccagctgatggccgccgagatcgagaagaccagacgccgcgtaaacgcgctggagcacgtcatgatcccggagacccgggagaacatccgctacatcaccatgaagctggacgagaacgagcgaagctcccaggtccgcctgatgaaggtcaaggatatgatgttggaggaagcccaccattacagcgccagagaagtggtgcctgtggtggaggaagcgtaacgataaagagaatcataaagagcgccgtcccggtcccgcagtttacgcgggggcgggacgtttttttgcggaagaccgtacggcgcccggcccggcggcagtcctccgctttgcacaaattttacattaattttccttaaataccacttgcgttgtatattctgacgtgatataatcaattcaatggattaaataaacgataaaaacggctgctgatttcaaaataattgcgattttacatgaattttactactttttaacaaaaaatatttaataaaataaatggattaaaaaagcaaacagcatgccaggcgcatgttgggatagattttcacaaacacaaagcggtatggaatcgcaaaaggaggaaaattatgagattaaaaaaatttgcagcgatcgggctggcggctttgatggcggcgtcgacggccggatgcggcggcggttcaggctctgcgtccacagaggcccccaccacaggcgccaccgaagcgacggaaacgtcccaggctgagactgcggctgagagcgcggaggagaaggctgagccggaaggaaacgtggaccgcagcaaagagctggtggtctactctaactccacctccaacggccaggacgagtggttgttaaaggttgccaaggaagccggattcaatattcagatcgtatccatcgacggcagcgccctatccgaccgcctggtggctgagaagaacaaccccgtctgcgacgtagtgttcggcttgaatgcggtggagtacgagcgtctgaaaaaggaggaactgctggtcaaatatgagcccgaatgggtgggcgaggtggacatgtccctgggcgacgcggacggctactattaccccacggtggtgcagcctctgcttctgatctacaacaaggacatcgtgaccgatccgcccaaggattggcccgacctgtgcgatcccaagtacaagggccagtacaacctgttccagctgcagggcggaacggccaagatgatcacggccagcatcctggcccgctatcctgatcccaacggcgagtacggcgtgtccgaggagggctggaaggtcatcgaggaactctacaccaacggctactaccagcaggacggcgacgactacatcggcaacgtgattgacggcacggttcccatgtccgagctctggggcgcgggcgtgatccgctaccagaaggagcggggcgtggagtttggccttatgctacccgagatcggcgaacccttcgtggtggagcaggtgggaatcataagcggcaccgaagaggaggagctggccaaggactttatcaactggttcggaagcgctgagatccagaagggctggagcgacaacgtgggcgccattcccgccaaccagaaggccctggatatgatcgacgacaaggacatcaaggatctgatgagcaaggtgaagattcaggatgtggactgggggctggtgagcgagcacgtcaacgactgggtggagaagattcagctggaatatcttgaatagcagtaactgttcagtcggcctgcgcacttgctgcgctgaccgtacgaaaacctgtgcttacaggcaaaaatcccattgccgaaggcgattttcatggatttttgctcgtatctgtgagggtactgaaccgatacgaatcgcaaataatgtacaggggcaagtcaattcgtttggcctgccccatttctctattttatgaggtggtaattgtgattgaattgaaaaatgtagagatccgctatggggattttgtagctgtcgacaatctgaacctgaccatcaacgagggagaatttttcaccttcctcggcccttccggctgcggcaagaccacaaccctgcgggctctggccggattcaacatcccctccaaggggcaggtggtgatcgacggacgggatgtgacggaggcgccggtggagaagcgccagatcggcatggtgtttcagagctacgccctgtttcccaccatgaccgtgtatgagaatatcgcctttgggctgaaggtccgcaagatgaaggcggacgagatcaagcggcgggtggacgaggtggcggaaaaaatccgcatcagcgctacccagctggatcgcaatgtttccgagctctccggcggccagcagcagagaatcgccctggccagagccattatccaggaacccaagatcctctgcctggacgagccgctgtccaatctggacgccaagctgcgcatcggcctgcggggcgagttaaaacgcctccagcgggatttaaatatcacgaccctctacgtgacccacgaccaggaggaggcgatgaacctgtccgaccgcatcgcggtgttcaacaacggctacatcgaacaggtgggcacgccatacgagatctacaacaattccgcctcggaatttgtctgcgactttatcggggacatcaaccggctggacggcgggattctggaggagatcaaccggcagaccggcgggacgggaggaaagcgcctggatgccgggaaaaccggatttatccgcctggagcgggtgctgtccgaacccagggagggctgcgccggtctcaccggtacggtggaagagctggagtacgacggcatgctggcccggtaccaggtgaatgtgtgcgggcagcaggtgaaatgcgtggaaaagaacgacggcagggcgtttttcaagaggggacaggagatccgtctgtatgtgaaccccgactatgtgatgcagttctagcccgcgggaggtggatgaatcgatatgaaaacacacggcagaaaacagaaaatgacgccccaggccattgccatccgcatcgtgctggtctggtttatcgcggcgtttattctatttcccaacatcaatatcatgatcagcgtgctccaggaggacggccggttcagcgccgaggccattaccaaactgttaaagtccaagcgggcggtgaagagcatgatcaacagcctggtgctgggcatcagtctggtaattacggtgaatctggtgggcaccctggtggtgctgttcacggaatactgggacattaagggagcgtttttcctgcggctggcctacatgacctccctggtctacggcggcgtggtgctggccatgggctacaagttcgtgtacggctccaaggggatcgtgaccaagggcctgaccctcctgttcccgaatatgaacgtcaactggttcacgggcttcggcgcggtgctctttgtcatgacctttgcctgtacgtccaaccacatcattttcctgaccaacgccatacgggccctggattaccacaccatcgaggcggccaggaacatgggggcctcggacagccggattctcttcgaggtggtactgcccacgttaaagcccacgctgttcgcgctgacgatcatgacctttctcaccggtatctgcgcgctgtccgcgcctctgatgatcggcggcagcaagttccagaccatcaaccccatgatcgtcagttttgcccagtctccgggatcccgggatctggcggcggtcctggccatgattctgggcctgatgaccattgtgctgctgtttatcatgaaccgggtggagcggaagggaaattacatatccgtgtccaagaccaaggcgaaaatgcgcaaggccaggctgcgcaaccccgcggccaatgtggcggcccatgtggttgcctacgccatgttcgtgatctacatgctgcccatctgcctggtggtgctgttctccttctgcgacgccctggcgatcaagacctcgaccctgtccttaagcgccttcaccctgaaaaattacgtggcgctgttcacgaaacaggacgcgttcaggccctacctggtgagtatcgtttactccgtggccgcggcggcgggagcctgcgtgatcagtgtgattgtggcccggtttgtgcgcaggaacgagcacaggaccgacgcgtttttcgagtacggcctgctgattccctggatgctgcccaccacctttatcgccctggggctgatgttctcctacgacgcgccgcgggcggttgtgggcggtaaggtgctgatcggcagcatctggatcatgctgatcgcctatattgtggtcaagcttcccttctccttccgaatgatccgggcggcgttcttcggcgtggaggacagcctggaggaggcggcaaagaccatgggggcgggaacgtcctacacgatggtccgggtgatactgccggtgatcatgcccacggtggtctcggtcatggctatgaattttaacgcgctgctttccgattttgatttgtcggtttttttatattctccaaaatatcagccattaggtgttataattaagtcagccagcgacgagggcgtgaatgagaacgcccaggccatggcgttagtatattccgtggtgctgatgattctgtgcagctttgccctttacctgacccaggggggcggggcggcaaagatcaaaaagaggctgtttggccggaaacgccgctgagccataaacatgtagaaagaggagcttaaactgtatgagaagattgacaagtcccgacagaatgaaactgatcaatgaaaagaatatcctgaaaatcgttcatgagaatccggggatctaccggaagctgatcgcggaaaagacaaatctatcttcccagaccgtcaccaacctggtgacggagctcgtcgagcgcagggtgctcttggagtatgcgccgtccctggggatcaagggccgcaaccccgtgtccctgtccgtcaactactcgggcttctatatgatcacggcggacatcaacatcggccgggtggcggtctatgtaaatgccctggacgagacggtgattgcctcggaggagcgcccggtgggccagaagacggacgtgctgaacgttctcaaagagatgatcggccaggtgttggagcgggcggggacggtaaggaccatcctggcctgcgccatcagcgtcaccggcgttgtcaacgaggacaagggcatcgtggtggaggctggaaaactgaactggtacaatctggatctggccggggagctgtcatacctgggcgtgcccgtgctggtccgcaacgacgcgaacatgttcgcctactatgagaaatcgcagtttccggcggatttgaactttatgatcgccaagatcgacgtgggaatcggctccgcctttgtgctgggcggccgggtgctggagagcaccaacaacgtggccggagagctgggccacgtgaccgccatggctcagggcgcggagcggccctgcgtctgcggaaaaaccaactgtctgacgaaatttatctccctggaagctctggaggcggactacggaaagccctacggggagttggttgaggatgtgaggcgcaaggagccgaaggccgtggcgctgattgaggatgtgtgcgcatacctggctcccattctggccaacgtgatcattttgctggacctggaccggattatcctctgcggctgcacggtggagtattttgaatccatcatctacccctgcctggaccggaaaatccgcaagctgttgagctattgggtttccttcaaacggctggagatccgcaccaacgtgaagatcacggccatcagcagccggttcctgctggactattatttttccacggagagcgatatcagattgtgatgggagcgctatgaacaactatttggatattgtggacagccgctggtcctttggaagctattaccggaggcgttttttgggggacacgctgtacacctgttttttctataaagatatcgagctggttctggaccgggaacacgcagcggtccgggaccggtttgcggaggagatgaaccgggaacatgagaccggcggggaggtgttagagcggtattaccggcagttgaggcgctttttcgaccagatggagtcctacgaccagtggactctggagcagatttacggcagcgtccacagcatccgcaagcagtttctgggcgcaggcgccatcgagaaggcccagatccgcaggtgcctgggatccgggaccatgggcctgggcgcggggattgaccagagcggcgtctggcagcgcctgatggaggacagcaacggggtggtgttctgcctggcggacccgaattatttccaatatatggtaaacgacatggggcgggcggcggagctgggaaaggatctctacgtgctcaccggtcagaccgccggggatgcgatcctgacccgggaggccctggccgcgctgcccggtatgactccgggaggcagagagccggtatttttggaggacagggcaagatattcgctgctggatttgtccgcagtccggtacaaggaagggttgcagcaggatattgacctgggaaaggccgttctcattgtctacggggacgacgggctgttccactgccggaatctgaatctgccgtccattgtgcgcaccgtgccgtcctgctatttcgcaagggccattgcgggccagttcgtgggccgcgggctctgcaccatctatgtgccgcctcattttgacattctgcccctggtgcctctgattgaaaagaccagagcgtcctactgccagcttgcgcggctggagcgggacttcgggcccgagatctatgagctggggctggagcggctgtacgcccggtatccgcagtattttatcaatatttacggggaaggcggggaggagcggctgccggtgcgcatggatagcggcgaggaggattcctgcagtccgtatttctacggctcctactgccgccggcgtgaggagctgatctccgggtatctgaacggcgttcccggcctgcggtatatctcagcttacatggatgggaggacgctgtcggagattccggtcccctggggctgcgaggagccccaggacggcattctggtccagggcgccgtgatggcaaaggcccgcgggtcccgggtgatcctggcggatggcggcgcccgctcccccagggcgttggtggcggagggggaggaggaaggaatgctgttgatctcgaatttcctgtttttcctcacccccaaactagtctcctggtacaacgagctgcgccaggagcggccgatggagcagatcgggctggacggcggccacctggattacatgctccggtacgagggcgggcggcgggtggagacatttccactctaccggaaggcctgcgtggccatgaagcgggacggaagctttctgttctttcagtacgctttgggcggcgggagtatttccctgggagggcggcggctttcgtggacggcccaggatgtgaatccgcaggactcccccggccccgtctgcattttcacgccttaccgctcggctcacaggacggaggaaaaaacggacggctactgcgagtttgccggggagggccggttcaacctggtggtgatccaggacaaggtggtctgcgcccgcatgggggatgtgatggtccccagcatcggcgcggtggtgtccctggcgcgggagacgggggaggatttgatccgggccctgggctttgaagccgccggggacggatattaccgctgggacggcccggaggccgtgatctgcctggagccgcccgagggaatcggggcggaggactgggactcggtgtgctgggcctttggcggcggcatgtccctcataagcgatggcgaaagcctctttgaacaggagaccggcctgtcgcggctggaagacgagggatggctgggaccgctgtcacgtcagactcaggagagcgagatccacaggctttccaagcaccccaggaccgcggtgggcgttacggaccagggggagctgttcgttctggtattttccggcaggacggccttgtctgtgggggcggactacgcgcagatgggcagaatcgcccggacgctggtgcccaacgtccggcatatgatgaatgtggacggcggcggctccgcggtgttcggaatggcggtgggaaaggtgtttgtggagctcagctaccccgccacctcctataccagcccggccggtatggtgcgccggatcaacacacttctgtgcatgaaacaataaaatacccccattgcggggaatcactgcgcccgcggccggactccggcccgcgggcgtccatagacgtaaaggagacagacgcatgataaaattcggtacaggcggatggagagcgattatcggggacgaatttaccaaggagaatatctgcattctggcaaaagcaatggcggataagatgatctgcgaacaggtggatgggaaaggcgtggtcatcggctacgaccggcgtttcctgtccagggaggcggtgatctggagctgcgaggtcctggcggccgcggggatcaagtgttacttcgtcaaccggtccgtccccaccccgctgatcatggactacgtgatgaagcaccagtttccctacggtttcatggtgacggccagccacaatccggccatttacaacggcatcaaggtgttcaccggcgggggcagggacgccgacgaggttcagacccgggacattgagcgctatatcgcccgggtggatgcggccggtatccccagaaaacgctacgaggaggcgaaaaagcagggcctggtggaggagatctaccccatgaacgagtatatcgacggcatcatgaggaagattgacatggatgccatcaagaagagccagctgaaggtggccttcgacccgatgtacggggtcagcaagacggcgttaagcaccattctgatctccgggcgctgtgatctggacgtgattcaccaggagcacgacacgctgttcggcggaaggcttccggctcccacggcggacaccctgcgggcgctccagaaccaggtgatggagtggaactacgatctgggaatcgccacggacggcgacgcggaccggttgggcgtgatcgatgacaaggggcattttctccatcccaacgacattctggtgctgctgtactattacctgatccgctacaaaggactgaggggcccggtggtgcgcaacctggcgaccacccaccgcctggatcaggtggcggaggcgttcggcgagaaatgctacgaggtgcccgtgggtttcaagtacatttccgcaaaaatgacggagaccggggccgtgatcggcggggagtcctccggcggcctgacggtggccgggcacatcaacggcaaggacggagtctacgccgccaccctgctggtggagatgattgcggtcacgggcaaacctttgagcgagctggtcctggagatccggaaggagtgcggggaaatgtacatggaggagcgggcctacgagttcacggagcaggagaaggaacggcttttggaagtgctctatgagaagcgaaagctgccggacctggcagattaccaggtggaccgcgtctcctacatggacggctgcaaggtgtactttaagaacaacggctgggtcatcgcccggttttccggaacggagccgctgctgcggatcttctgtgagatgccggataaacaggctgccagggagatctgtgggttgtttgaaacgtatctgggcctatagaggcggggagagtgaacatgaaggaaacgattgacgtacagcagttgatccatataatacggaatatgaagccctgctttctggacggggaaatgtccggccggatcacctttaagggggatatcgactttgccacggaggcggactttgccgtgcagaggcaggtgcaggagcggcttctggcactgtacccggatatccagtttatgggggaggagaaggacaacagcggcatcgattttgcgggcgcggtctggattctggacccggtggacggcaccaccaacctggtgcatcggtttgaccacagcgccgtctcactggctttggccgtggattcccgcctggagcttggcatcgtctacaacccgtaccgggacgagctgtttcacgcggttcgcggaggcggcgcgtatctgaacggaaatcccattcacgtggggtctgcggcgcagatgcgggaagcgctgatcagcgtgggaacggccccctactaccatgagctggcggaccgtaattttgagcggatcaagagcattttcctggactgtcaggacatacggcggctggggagcgccgctctggatttgtcctatgtggcctgcggccgaattgacgcctatttcgagcccaatctgaaaccatgggactatggggcgggcgcgctgctggtgaaggaggcgggcggctgcgtcacggacttcgaggggcgggaaccggcgctaaaccggccctgctgcgttgttgcgggaacgccggggattcacagggcgctgctggagcggtatctgtgagattggggcgcttgtgtagctggttttgtgacggctgatccgctttactttccgtctccccggtgttaaaatgaaaccggaactgtgtccggctgggggaaattgcccgccgggcctggaattggtgaatgaggaacacgagagatggagacaaagcgcgttaaaattgaagatacagccagaatccatgacagggagcttttggaggcggcggagatactgcgggagggcggactggtggccttccccacggagacggtgtacggcctgggggccaacgccctggacgaggcggcggcccggaagatctatgaggccaaggggcgcccctcggacaacccgctgatcgcccatgtggcggaccctgaggatgtggaggcgctggtggagtacataccggagaacgggcgcaagctgatggaggccttctggccggggccgctgaccatgatcttccccaagagtccggccgtaccctacggtaccaccggcggtctggacacggtggccatccgtatgcccagcgacccggtggccaaccgcctaatcgccctggccggggtgccggtggcggcccccagcgccaacacctccggccgtccaagccccaccacggcggatcacgtctggcaggacatgaacgggcgcatcgacatgattatcgacggcggtcctgtgggcatcggcgtggagtccaccatcgtggacgtgtcctgccggattcccaccgtgctgcggcccggggccatcaccatggagatgctgcgggaggtgctggacgaggtgaagattgacccggccatccttggccccatgggcgctgatatgaggcccagggcgccgggcatgaagtacaagcactacgcgcccagggcggagctgacgctggtggagccgactgaggggcagggcgaggacgccgcagcggtggagcgcatgattcagcgggtgaaccggctggctcaggagaagctggcggccggaagccgggtgggcattatctgcaccgacgagtccagggaccgctacgagggcggtctggtgcgcagcatcggcgcccgggccaaaaaggagactgttgcccacaatctgtacgcagtgctgcgggaatttgatgatctgaaggtggattatatttattctgaaagcttttccgaggaccatctgggacaggcgattatgaaccggttgtctaaggcggcggggtatcatatcgagcgggtgtgagttggacgggcaggcggccggagttcgcccgcagacagggacttcaggaacaggaggcattcatggaaaagcagacgttaggcgagatcaccgcccagaagctggtgcggatgatccaggaaaggggatacgtacccggggacaagctgcccacggagatggagctgtccgaggtcctgggcgttgggcgcaacaccgtgcgggaggccctgcggatccttatgtcccggaatatcgtgaccatccgccagggctcgggtacctttgtgtcggagaagaacggaatccccgacgatcccctgggatttaccatgatggaggacaccgggaagctgacccgggatctgctgcaggtgcgggtgattctggagccgcccatcgcggccctggcggcccagaacgccactggggaggatctggcgcggctggagcagattttggacgaggtggaggccctggtgcggcagcggaaggactatgcggagaaggactcccagttccacgcccagatcgccgcgtgcagccacaacacggtgatgtccaatctggttccggtgatcaccgacggcgtgcgggtgttcgccagcgcggtgcgggagacggagtatgatcagaccctggtgtcccaccgggctattttcgaggccatccgggacaaaaaggcggtggaggcccagcaggccatgtatttccacctgatgtacaaccagaaccggtatttgatggaacagaatcattagaggcggcagctgggaagatacgtttcctaaatatccaaaattcatgggatgaatataaggtttatcccattttttgttgacttatattggataatgtgataaaaatattatatattcatgggatgaatatttgcccgttatcagaacaagtcacagatgccacgaaaaccaggaggggcggaggaaatggaacaacggtatgatgtattgattatcggcggaggcgtggtaggaagcgccatcgccagggaaatgtccaggtaccagctgaaaatcggcgtgctggagaagaacctggacgtctgttatgagaccagcgggcgcaattccgctgtggttcacggcggctttgcctatgacaccgggacgctgaaggcaaggctttgcgtggagggaaaccggatgatggaccagctgtcggaggagctggatttccggttccagcgctgtggaaaggtgctggtgggcaacacggacgaggacatggagaccttaaagcgtacgctgaagcagggcgaagccaacggagccaggggcctggtgatcattgacaaggaaagacttcacgagctggttccggcggtggtgggagaattcgccatgttttcaccctacagcggcattttagaccccttcaattacaccatcgctctggcagagaacgcccatgacaacggggtagactactatctggaccacgaggtgacggccattgaacgggatggggatggagtgtaccgtctggccaccgacaagggaacattttcggcccgctgggtggttaacagcgcggggctgggctgcggcaggatttccgacatgctggggatcaagggatacaaggtgattggctccaagggcgattatatcattctggacaaacgcaccggtccgctcctgcccatgcccgtctacccggtgcccagcaacacctatatgggcattcacgtgaccaataccaccgacggcaacgtgatcatcgggcccaacgcggagacggtgtcggacttcgcctactacggcgtaccccaggagaacatggattatctggcggacagcgcctccgacctgtggccctgcatccacaaatcggactacatacgcaattactccgggattctgccaaaatgggtggacgatcaggggatgatccaggatttcaggatcgagattcgggacgatctggctccccgggccatcaacctggtaggcatcgagtccccgggcctgaccgcggccgtgcccatcgcccggtatgccattgggctgatgaaggagcgggaggagctgaagcccaacccggacttcaatccggtgcgcaggggaatcgtccgttttgcggagcagtccatggaagagcaggcccgcctgatcgccgcgaacccggattacggcgaggtggtctgccgctgcgagaaggtgaccagggcggagattctccaggccatccacaattccctgggcgtggacaccatggtggggatcaagtacagaacacgatccatgatggggcgctgccagggcggctactgccagatgcgcatcgcaaagatgattgaggaagagctgggaaaggcagagacggatgtgcgctatgccagagccggttcgcagatgttcttcggcaaagtccgtgaggaggtgcagtgatggagattcgtaaagaaaatgtggatgttgtcatcgtgggcggcggaccggcaggtctggcggccgcggtcaggctgtacgagaagggagtccgtgacattttgatcattgagcgggaacggcatctgggggggattctgcgccagtgcatccacgacggattcggactgacccgttttagaaccaccctcagcggcccggagtacgccaggcgcttcatcgaccaggtgaaggagcttgggattccctatgtgacggacaccacagtgctggaggtgagcagcggcaaggttgtgaccgccgtttcctccggcggactggtgcagtggcaggccaaagccgtgattctgaccatgggctgccgggagaggacccgcggagccctgggcattcccggggagagacccacgggagtgtttaccgcgggggtggcccaggcatatatgaacctgtacaaccggatgcctgccaaagaggtggtgatcctgggttccggcgacatcggtatgatcatggccaggcggctgacgctggagggggcccatgtgaaggctgtgtttgagattcagccgtatcccagcgggcttccaaggaacattgagcagtgcttaaacgattacggcatcccgctgtttttaagccacacggtgacggagattcacgggaacgcgcggctttcaggggtgacggtgtcggaggtggatgagcgcatgaagccgattccggggacggagaaggagtacgcctgcgacacgctgattctgtccgttggactgatcccggagaacgagctttccctggacgccggggtgacgctggatcagcgcaccaagggagcgctggtggacgaatatttccagacggatgtggaggggatttttgccgcaggcaatgtgctgcacgtccacgacctggtggacttcgtgtccatggaggcggaagatctggcggagagtgcggcggagtatgtgcgcacaggccgcctgccggagtgccccctcgcggtgcgcccggacgggaatatcaaccacaccgtaccccagcgggtcagtggaaccagggcgttcaagctgtccatgcgggtgaaccggcccatgaaggactgccgtgtggtggttcgccagaacggtgtggagcttgcgtcaaagaaaatgaagaaggcaatcccggcggaaatgatccagctggccgtaaaaacggaccggatcgcgcagaacggggatctggaggtgagcgtggaatgttgagagagtttacgtgtattatctgtcccaatggctgtgagattaccgccggggtggaggacaatcagatcatatccatcgagggcgctctttgccctaaaggcgaggcctatgtcaaccaggagctgaccgatccccggcgcaacatcgccacatcggtgctggtaaagggcggcgagctgcccctggccagcgtgcgcctgacaaaccccattcccaaggcgaggatattcgacgccatggccgagattcgcggcatcgcggtggaggcgccggtggaagccgggaccgtggtgatcagggggattctgggactggacagcgacgtgattgtgacgaagggggtggggaggcggcagcttcccgaatcataggatttttcagcaacgggccgttggcgcggcccattgcattcaataaagcaggccggaacgcgatgtgatacgcgtccggcctgtatttcttatatgccaaattcctgaaacagctgttcctgatatgcggagtcctctgcggagcggatgatgtcatccgcacggccagctgccgccagccgggtgatcagtgcgttcacccgctcctggccgtgctgggtgccctgtacgacgcccgcttccaggccctcctcatagctgatctttttctcgctattgatatgcagttcctcgtcgtattccgataagatcatttctctcacctcctcgcggtgtttcaacaggaagttttttaaaacgtcatgctggatacaatcttccacggcctgatccaccgctgcttccaggtgaaggccctcattcagacggctgcggactgcgttgatcagaaacgcgtactcgtacagcttccggcagctcttcatcatttcttcattatgcccatagttgatattgatcatggtggcggtgcactccaggcagggaacgccttcggcctggtagaacaaatcggacagccgcagctgtgtgcggtccggctgttccatgtcccgttgtaaaacacgatgaactccggaaacggaagggacagcggtcgccgggattctcatagtgggaaccgttgatggcattgtagagctccagcagttccttcttctcactgaatatcacccggaacaggctgtccttaaatttgcggtttacgcgcacaattaccatgtgcatttctcctttcattgtactataaacagagtgggattgtaaatggttgtggagggatgaattcagaaatgaatcatgaaccgttacggttcacaggtaatatcccgcgaagcgtttttggtgagtggagcgtagcggaagtcacagaaaacccgagggtagcggcgcgaaacagcgctttttgctgtttctgtgcatcgcgaagcgtgttaccgggaacggagtgaacagtaatcatgaaccacagatgcccttggggcctggaacagtttccggcggcgcaggaaactgttttagaaagataagaacagaatagcacaatccggccgtcggcgcaacatcgacttttcctgtgattgccgtttcacatgttattgtttttttcttcaatatgttctatgataaaaggaaacagctttggcggcgggccggtgagacccggacccgccgggagagaatgcttgaatttacggattgaggaggagaagaaaatgacaggaaaacgcacggattatattacgtgggacgagtattttatgggggtggccattctggcggggaagcgttccaaggatcccagcactcaggtgggagcctgtattgtgagcccggacaataagattttgtccatgggatacaacggattccccaaaggctgttccgatgatgaatttccctgggaaagggagaacgaggcggacgacccctacaacgcgaagtatttttattccacccacagcgaactcaacgcgattctcaactaccggggcggaagcctggagggaagcaagctttatgtaaccctgttcccctgcaacgagtgcgccaaggcgattatccaggccggaatcaagaccattgtgtacgggcaggacaagtatgcggatacccccgcggtgcaggcttccaaacgcatgctgaacgcggcgggcgtgcgctattaccagtatcagtccaccgggcgcaagattgagattgaggtgtaatcccatgaaatttcttttggcggcggtgaacgccaaatatattcactctaacctggggatttacagcctcaaagcctgcgcggacgcccgtatggccggggggccggtggagatcgagctggcggagtacaccatcaaccatcagccggaacaggtgctccaggacatttaccgccgcaggccggaggcggtgggattttcctgctacatctggaatatttcctttgtccgggagctgatcgccgacttagccctggtgctgcccaaaacggagatttggctgggcggcccggaggtttcctttgaatgcgaaacgctgctgcattccctgcccgcggttcggggcgtgatgaaaggggagggagaggagacgttttgcaggctggcggcggcctatggggaggctgagaggctgggagcgccgttgcaggcggagcgtgggatcccaggcccgtcggacgccgatctcgccgccatccccaacctggccttccggcgccgcgacggcggtattttccagacgccggccgggccgccgtcggatatgggttcatttccattttcttacaaacaactgggactagagaatctggagcatcggatcatctactatgagagcagcagaggctgccctttttcctgttcctactgtctgtcctccgtggacaaggcgctgcgtttccggtccatttcccaggtaaagcgggagctggactggtttctggagcggaaggtgccccaggtgaagtttgtggaccgcacctttaactgtaagaaaagccacgctctcgccatatggaggcatatcctggagcatgacaacggcgtgaccaactttcattttgagattgccgcagacctgttggacgaggaggagatggagctgctggagaaaatgcgccccggcctggtgcagctggagatcggcgtgcagtccaccaatccggaaacgctgcgggagatccaccgccgcacggacatcggggagattcgccggatcacggcgcgcatcaacagctggcacaatatccaccagcacttggacctgatcgcggggctgccctgggagggaattgagtcgttccgaacgtccttcaacgaggtgtacggcatggagccggagcagctgcagctgggatttttgaaggtgctgaaaggttctcatatggcggagatggcggaatcctacggcctggtgtattcccggcgtccgccctacgaggtgctctccaccagatggctgtgctatgaggagctgctggagctcaagggcgtggaagagatggtggagatccattacaacagccgtcagtttgtccacacacttgggctgctgcaggaggagttttccacaccctacgacatgtttctgcacatagcccggttttaccgggaacaggggtatgcggggcttaaccacagccgcgtggcccgctatgagattttgtggaaaatgatcggttccctcaccgtggattgcggacggagggagatttaccgggatgcgctggtcttcgacctgtatctgcgggaaaatgccaaaagccggccggaatttgcacgggatcagaatccttttaaggagcggatgcgggaattttaccgggcggaagcggagaaacccaggtaccttccgggataccagggctgtgacggccgccagcttcagcggatgacccacctggagggcatgggagacgggacctttgtgctcttcgactaccgggaccgggatccgctggattacaatgccagaacctggcgtttggatttggacggagcggtaagacggtgaacggaaccgtgaaaaaggttgacataaagctgaaaatgtgctaaataatagaagcttataattgcgaggagccgttatgggcgcagaatgaacacactgagaaaggaatacggaccggaatggcaagacgagagacaaaagcgcagcaggcggagcggatccagaagatattggcggcactggaccgggagtacggcacggaataccgctgttatttgaatcatgaaaccccatggcagctgttgatcgccgtgattatgagcgcccagtgcacggacgcccgggtcaacatggtcaccgccgatctgttccgcaaatacgacaccctggagaagtttgcgaatgccgacttgaaggagctggaacaggatattcactccacgggcttttaccatatgaaggccaaaaatattatcgcctgttgccgcgacctggtggacaagcacggcagcgaggtgccgcggaccattgaggagctgacggcactggccggggtgggccgcaagaccgccaatgtgatccgcggaaatatctacaatgaacccagcatcgtggtggacacccacgtaaagcggatttcccgcaagctgggcctgaccaaatccgaggacccggttaaaatcgagcaggatctgatgaaggcgctgccaagggatcactggattctctggaatatccacattattaccttgggccgcagcatctgcatcgccgccgtcccaagtgtggggagtgcttcctgcgggagttctgtccggggcgggaggatgagggataaaatgcttgctcggaaaaacaatcgcctgggggctgcaacagcggcccattgcatttaataaaaagacagaggtacagcctaaccgccaaacggtgatcggttgtacctctgtctttttgcccgaggtgatatgttttgcagctggcaggcggtcactgcgtgtgatgggccgcttgcacaccactacaacatcttctccgcaatcgcctgtgaggtcttttgtttatttttctccgcgtcgccgttcatgcgccggaacagctcggcgtaaagaatatccaccatgtacatctgggaggcgatagccgagatggaaccgccctgcatggggccctctctggctccgcattgcaggagaatatccgcataaggcgccgccggagtctttaaaaagctggtgatgaacaccgtggttccgccggactcccggacggacttggcgatctggatgcagtccttggtcatgccggagttgcagaagataatagccagatccccggggcgcagcagcgtggcggaggtcagctgcatgtgcgcatcgctggtgaaggagatattgggcataagccgcaggaacttgttctgcatctccagcgaggtgatggcggaacatccgaagccgtataagtaaatctgattggcggatatgatctggtccaccgtccggctcacggcctcaaagtttaagtaattgtaggcgtggttcagcgccgccgtgtagacggacaggattttctgggaaatttcccggatgtccctggagtccgccacgtccacattggcgttgatatccagcatctcgcgggagtgggtactgagtgccagtgacagcttgaaatcctgataaccgcccagcttcagggaacggcagaaacggaatacggtggtgtcgcccactccgcagcgctccgccaggtcgctgatggtcagatccagaacctcctgggggttttcgagcacaaaatcagccacttttttttccagcttggtgaaatggctgtaggatgagaggattttgtcaatcagattgacgtccgccatagagtacctccaaaaaaatgtatgtcatgtctacgattcgatggcctgcacaaagcgcttggtgatttccagaggtcttgtgatagcgcctccgatcacagccgcgtgtattccatccatagagagtatatcatggagctgctgcggcgtccagataccgccctcggcaatcacgggaattcccatggtctgccccagacgggcgatcagatccatgtccggtatctccgttccggccgtctcacgggtatatccgcgcagggtggttcccacgatatcaaatcccatgtccctggccgcggacgcgtcctcgtaagtggagcagtccgccataaagagctggccgggatatttcctgcggatcgcggcaaacagttccggcagggaaacgccgtccggccggggccggctggtggcatccagcgcgatcacctccgtaccgcaggcaaccagcgcatccacttcgcgttccgtgggtgtgatgaaaaccgggcagtccccgtacacgcgcttgataatgccgatcaccggcaggtccacggtctccttgatggccgttatatcctccaccgtgtttgcgcggattccggctgcgcctcccaacatggccgcgtaggccatccgggacataatataggagctgtggagcggttcctgctccaaagcctggcaggatacaatcagctttttgtgaacctgctcaagaaagttactcatttattagcacctccgaattgaaatgatgaaatgtcgcatacgggaaatgtatggaaaccgaccaggtcagagccgctgcccttattataaattacacaaagaaaaaacacaagaataaaagaaaaatttatttttatatccgttttcgatatgaaataaaaaatattttcgttttctatgttgattttgcataatcggtatgctaatataaaagcacgggaaaggtatggctgtgttttataaaacagagctgaacatagtcaattatgatcatcaaaaggaggagttatcagttatgaggaaacgttatttagcaggggtattggcagcggttatggcaatggggcttacggcatgcggcggcggcagcacgcccaccacggcggagacgaaggcggaagcgaaaaccgaggcaaaggcggagtccgccggggagcagtccgctgcggagagtaaggaggaagccaagaccaccggcggaaagctggttgtgtactcccccaactccgaaggcatcatgaacaatgtaattcctggatttgaggagaaatacggcatcgaggtggaagtgatttccgcgggagccggagaactgatcaagcgcctgagctccgaggcaaacgatccctatgcggatatcgacttcggcggcgtgaactatgccatttacaaacagaacccggatctgtttgaggagtacgtgtctcccaacgacaagaaccttccggaagaattccagaatacaacaggtttctatacaaactacaccatcaacggcagctgcctgctggtgaacaaggacctgatcggagatatcaagattgagagctacgacgacctgctgaatccggagttaaagggaaagatcgctacctgcgaccccgccacctcctccagcgcatttgcgcagctgaccaacattctgctggccaagggcggatacgacagcgacgaggcctgggattttgtgggcaagctgatcgagcagtgggacggcaaggtgctgtccggttccagcgccgtgtacaagggcgttgcggacggcgagtacaccgtgggtctgacctacgaggatccctgcgcaaccctggttgcggacggagcgccggttgagatcgtattccccagcgagggcgccgtatacctgcccagcggagccgcgatcatcaagggtgccaagaacatggacaacgccaagctgttcatcgattacctgatttccgatgaagtacagcagcagttcggcgacaacttaaccatccgtcccattatcgcctccatttccagcaagacccttacccccatcggcgagattcataccatcaccgaggacattgcctacatcgcagagcacaagaacgagattgtggagcgctacaaagacttatttgcaagcctgcagtaaggtaaaatacagcataatgttcatccggcccgcgcaggagctgcgcggcctcaaaaaacgtggaaaagcaggcacaatcccaccgccgcaggcgtttatccgggattgtgccggtaactgccggggtatcggacagttgccaatcaaggcctctggaggagatataacatgagtgttgcaatcaagatcagccacgcagttaaaaaatacggtaacaacacggtgattccggatctgtcgctggacattcgggagggtgagtttttcaccctcctgggcccctccgggtgcggaaaaaccacacttctgcgaatgatcgccggctttaacagtattgaaggcggggatttttattttaatgagaaacggatcaacgacgtggagccgaacaagcgcaatatcggtatggtatttcagaactacgccattttcccccatctgaccgtgcgtcagaacgtgggcttcggcctgaaaaaccgcaagtgcagcaaagaggagatggagagccggaccgacgagtacctgaagctcatgcagatcgaggagtacaaggaccgtctgccggagcgcctctcaggaggacagcagcagcgcgtggccctggcccgggcgctggtgatccatccggacgtgctgctcatggatgagcccctctccaacttagacgccaagctgcgggtggagatgcgctcggccatcaaggacatccagaaccaggtgggcatcaccacggtttacgtgacccacgatcaggaggaagccatggccgtttccgaccgcatcgccgtgttcgaccacggcgtgatccagcagattggaacgccccagcagctgtaccagcggccgaagaacctgttcacggctaccttcatcgggcgaaccaatatcgtggagggcacgctgaccgtcgggggaaatggaaccggaagcctggtgctggcccggacctgcggcgcggacatcaccggccttaggggacttggaaacggcacataccccgtgaaggtttccgtacgcccggaggagtttgtcatccatgagtcggggaaagccggggcggtggaggccgtggtggagagcagcattttcctggggctgaacacccattacaatgtgcgccttgccacgggagagcgtgtggacattattcaggagtccaccatcgaccacattatcaagccgcagacaaaaatatccctgaccgtgaagcaggagaagatcaatattctctccgaggacggcagccgcaattacttagtgggagtggaggacgatgaagagtaaattcaaactggacgtttggggttatattaccatcgcactgctgggcgcgtacgcgatttttctgctgtaccccatgctgaacctgctccggcgctccgtgtacagtccggacggcgttttcacgctgggctatttcagcaaatttttcggcaagaaatactatttcgggaccctgttgaacagcttgaaggtgaccctgtgcaccaccgtcaccacgctgcttctgggcgctcccctggcgtatttctttaccatgtataagatcaagggcaacggggtgctcagaatcctgatcatcctgtcgtccatgtccgcgccgtttatcggcgcatattcctggattcttctgatgggcagaagcggagtggtgaccaccttcttaaaggacaccttcaacatccagggaatcaacatctacggttttgcgggtatcctggtggtgctgaccctgcagctttacccgctggtattcctgtatgtgtccggtgccctaaagaacatcgaccagtccttaatggaagccagccttaacctgggctgcagcggcgtgaagcgcttcttcagcctgattatcccgctggtcatgcccaccattctggccagcagcctactggtgttcatgcgcgccctggcggatttcggcacgcccatgctgatcggcgagggctaccggaccttcccggtgctcatttacaatgaattcatgggcgaggtcagcggagacgacggcttcgcggccgccatcagtatcattgccatcatcattacagcattgatcttcatggcccagaagcacgcctccaacaagctggcgtttaccatgaacgcccttcaccccatcgaacccaaggaactcaaaggcgtccggggagtgctgatccacctgtattcctatcttgtggtcggtctttccatcgtgccccagtgctacgtgatttacacctccttcctgaaaacggagggcctggtgttcaaggacgggtactggctgggcagctaccgcacggcgttttccaagatgggcagttccatcgtcaatacctttgtgatcgcgggcagcgcgctggtggtgatcattctcatggcggtgctgatcgcatacctggcggtgcgcaggcgcaatgcggccaccaataccatggacctgatctccatgatgccctacattatccccggttccgttatcggaatcgccatgttgatctgcttcaaccggccgccgctcatcatcagcgggacctttttgatcatgatcgtagccctggtcatccgcaggctgccctacaccatacggtccagcgtggcgattttgcagcagattcccatcaccatcgaggaagcgtccatcagcctggggacctccaagatgaagacatttttcgccatcaccattcccatgatggccaacgggatcgtgtcgggggcgatattgagttgggtgacgatgatcacggagttgtccacggcgattattctgtatacggggaagacgaaaacgctgacggtgtccatttatacggaggtaatccggggaaattatggagtcgcggcggcgctttccacggtgttgacgtcgttgacggcgttgtcgattttgatctttatgaggatttctaagtctaaggatattacgatgtgagtgaaataaataatatccctgcaaccgttgcttttgggagtaacgggtgtggggatttttttagggaggtggggtggaaggggaacgcggacgggataaggtagttccggaaaagaggtgggggacgggcagggaggccgggctcatagtccgaaccgggggatggctctaagcccagagaggacgctccgcagggggatcgggaaaactccggcgcaggccggatgcctgcccctccgtattccctttcgctcgggcgtggagcgccctccctcaccccctgctccgcgtcctctccaggctaagacccatctcccctcccggaaaatcgcccagcccccctgcccgtcccccacctcttttccccctcaatttttctccccgtccgctggcgcatccacgttatagaagaaggtcgcccgcccattttgttgcctgcggcaaaagatgtatgccccattaggttgattcgtgagtgggtggggcgtagaagagctatttatagcgtattaggttaaggaggagcctggaggggcaaagaaatgttttctttctctccaaaaacgtggaagtgcgagaggggaagagagaaagagtagtgggtgagaggcaggggagcgggggaggaggtgactgtggagtggttcggagaatcttgggcggaaggggtgtgaaaaggtgggattgcggagggctctcaaagcccgcagcaaagcgtagccggagggggccggcatcaggccggcgcccgtagtgcggagcggtgcccgccttttcgcgccccttgcgtcctagactctcccaccacggagccctggaacctcctcccccgctcccctgcctctcacgaacgccaccccctcccccaccacccctctccctcttcccctataagcccccttaatcacttcttatcacctccccttatcccatcgtgcaagcccacaaaaaaaatttcaactggttgtgcacttgaacaagatataaaattcctgtcgcatttcattgaaagaagtcgctcaaaatgatatgatatcctcataataaacaaaaaagaaacagatatttaggaagatactggacaatatagtatcttcctttcctgataaggaggaagcgcctatgccggattccgtattaacccgttattcctgccgtgaattcacacccgacccggtcaccgtggagcagctgcaggccatcatccgcgcagggatgcaggctcccaccgccaagaacgaacagccctgggaatttttggttgtccgatcagagcagggcagggaagcgctggccgcgtccagcccctacgccgggagctgccgcagagcgcctgtggtgattgtggcgctggcagatcagaaccgcatttcaccggaaagcccctggtgggtgcaggacatgagcgcctgcgtggagaacatgctcatcgaggccgtggaacaggggctgggcggcgtgtggctggggatgtaccccaggcaggaccgggtgagcgccatccgggaggcgtttgaactgccggaaaacctgatccccttcgcagctgttccggtgggatacccggcggcgcagcagaaggcaaaggaccgcttcgacccgaagcgcatccgttgggaaggatgatccgtcgggcgcagccctttcataaggagcgattatgagtgtatatttgtcggtagcccaggcccagaatatcgtgttcgaactgatggagatcgtgcccaagggagtcagtgtggcggatgagaacggctgcattatcgccagctccagcgctgcgttcctgggaaagtcctccaggctggccaaggaatgcatcgagcaggccggccagctccagtcctacaatgagcggcattatgagggaaataccaccgccacgccgctgttcttccgggacatctgcgtgggagccattattatgaccggggacccggagcggatcaaacggctgacctccatcgccaaggcggtgggcgagagtgtgatctgccagccctatttcaacaatcccgaccagaccagctacgtcatgtatttcgagtacctgacggagtggctgaacaatacggaggagtacaccctgccctttatccgcaggggcgtgcgcctgggaatcgatgtgacgcagccgtactatacggtggtgctggacggcatctggaacccggtcagcgcccagaaggcggtggagcggatcctcagcggacccaactattacctgtgccacaacaacagctgcctggtgctgatcctgcaggagggaaccgacgagtcggtgctccggcaggtggcggccctgttccacgacatcaagatcgcggtgggcagcgtggagaccagtctgaaccgctcctttgtggtggctcagaacgccctgttcgcgggcaaacgcctccatccccagaaaaatatctacgattaccgggattacgagtttgcctacgccctctcgaaaatccaggatctcaaagtcaaaaagggcgtgctggaactatttgaacagccccagcacgcggacctgcttcagaccctcgagatgtacatccaggaaagcggcaactccgcggaggtgatccacaagctgttcatccaccgcaacaccctgaaataccggctggacaagattcaggagctgaccggaaagaaccccagaagtttccaggacctgttttatctctatgtcctgtacgtcctgtaccgtctgtcaaagtgacggtacaggggtaccaagcggactgcgccaagcgattgttccgccttcataacggatacaatatacaatgtacatgttctgagaatgaacccccaaccatgtgagtatttggccggtttccggctgataagtgttatacaaccaaaggaggataaagatgaagaagtgtggaaagaagctcatcggtttgctgatggcggcggccatggtctcgactatggcgctcagcggatgcaaggagaaagcgccggagactacggcggctgagacaaaggcccagacggaaggcgaacagaatacgccggaggcggcgggaaccgagagcgcgggcggggagagccaggctcagacggacggcaaggaccccaaccgtctgatcaagatcggttttctgtttagcaacgtgatcagcacggacgcgtgggctcagacccatgagaacgccaggctgtacctggaagagaactgtgagaacgtggagaccttcaaggtggagaacatcgcgggcggcgcggactgcgagcgcgtgatgagagagtacataaacgacggctgcgagatcattgtgggcacgtccttcgactatttggactacatgctggctctggccgacgagtatccggacatcgcgtttatcaacggctccggctatgagaccaaggacaacctgtccgtttacatcgccaagctggagcaggggcgttacctgaccggcatgatggcgggcgagctgacggaagcggacaagatcggctactgctccagtatccccttcccggatcccatcaaacagctgaacggctttgcagcaggtgtggccgccacgaacccggatgccaaggtagtgaccctgtggtccaactccttcaacgaccccaccaccgacgccctatgcgccaacaccctgatcgaccagggctgtgatctgatctgtatcgacttaagctcctccgcggtagcgcaggtttgcgaggagcgcggcgtgaaattcatcggcagctccgtggatatgcgggaattcgcacccacgcagcagctcacttccaactgctggacctggggcccctggatggccaagcaggttgaggcggtccgcgaaggcaactttaagggcgcctggtgcgagctggacatcaacgacggagccatcagcctggcggattacagcgacgcggttccccagaacgtgatcgatatgatcgaggagcagaagcagaaatttatggacggcgaggaagtctttgtaggcccgctgtacgacaacaccggaaagctgcgggtgcccgagggcgagtccctgaccggcgaggcggccaacagcatgcagtggttcctgcccaacgtcatcgacaactgggcggataaaccggcagattaaacggaggcagcaggcggatcagacagcgccggggcgggcgaaagacagaacagtccaccccggcgtttttattggagggaataagccgccggacggggtatccccccgtggcgtgcgctctgattcagaacaggaaggaagaaggtaaatggctgaaattgcaacggtagaaatgaaacagatccgcaaggagtttcccgctacgctggccaacgacaacgttgatttcaccgcctacaaaggggaaatccatgcgctgctgggggaaaacggcgcagggaaaagcaccctgatgaacatcctcaccggcgtgttaaggccggacggcggagaaatcctgattaacggagcgcgggtctccatgaagtcgccgggggacgctctggcgctgggaatcggtatgatttaccagcattttaagctggtgaagccctttacggtggcggaaaacatcgtgctgggcatggaacaggtgaaaatcctcaaaaagcaggccctggagcagcaggtgagggtcctgtccgaggagtataaaatcgacatcaatcccgcctccgccatatggcagctgtccatcggcgagcagcagcgggtggaaattttaaaggtgctgtaccgcaaggccaatatcctgattctggacgagcctacggcggttctgaccccggacgaggtgagggagctgttcggcaccctgcgcaacatggccgccatgggctgcaccatcattttcatcacacacaagatgaacgaggtgatggagttcgcggaccggatcacggtgctgcgggacggccgcctggtgaaggccctgaaaaaggaggagaccacggagcaggagctggcccagctgatggtgggccgggagatctccatgggacgccggaacacggaaaataccaccagaaacgaggcgattctgcgggttaaggacctgaccgtgttaaacgacaagaagctgaaagcagtcaatgatctgagctttgacctgtacgctggggaaatcctgggcatcgcgggggtgtccggaaacgggcagaaggagctgatggaggcgctggccggcttaaggcccaccgtgtccggccatctggaggtccggggggaggacatttccaggtcctcgcccagggagcggatcagccggggcgtggcctttatcccggaggaccgctacggtttcgcgctgatcaagaccatgaccgtgacggagaacgccagcttaaagtgctaccgcaagccggagttctgccgcaggggcgtgctcaattaccggaagctggagcagcaggccgggcggtttattgaagaatttgagatcaaggtgggcgggcctaagagcctggtgcagagtatgtccggcggaaacgcccagaagctgattctggcccgggagacggcggagaacccgtcggtcatcctggccagctacccggtgcggggactggatatcaaggctacggagagcatccacaagatcctggtccaggaaaagtcccggggagccggcgtgctgctggtgtccgaggacctggacgagatattccagctcagcgaccgtgtggccgtgatgtacgagggaacatttatgggaattctgcccgtcggcgaggtcggtctggaacagatcggcatggccatggcgggagcggcccggttagggggtgaggcgtgatggaagggacaatcaaacggcagagagctttgacgcttgtaaagcgcatggagaccccgggctggtttaaaatcgcggtgccggtggcctccatcatcgggggattcctgttttcggccatatttctgatggcggcgggggaatcgcccatcaaggtgtactccgtgatgttcggcggggccttcggctccctctacggtctgggggagaccgtggtgaaaatgattcccctgatgattgtttccgtgggcgtgtcctttgcctttaagatgcagatttggaacgccggaggcgagggccagctgcacatcggggcggctgccgccacttacgtggtgctgcacctgcagggctatgacaagaaaaccactctgaccgccgcgtttctggccgcctttatctgcgcgggcctttacggcctgatcccggccatattaaaggtaaaatggaaggtgaacgagctgatcacctgcctgatgttaaactacgtgggcaccctgttcatttcctggctgatccaggggccctggaaggatcccacgggctttgccttcccgcgcacggaaaaatttcccagggtcggggagatgcccacctttttcggcacgcgaatccacgctggggtggtgatcggcgtggtcatcgcgctgattctctggttcattctggccaaaaccaagtgggggtatgagatcaagctcatcggcaccaatcccagggtggccgagtacgccggaatcccggtgaagcgctacgtgctggccgtgatgttcgtcagcgccggaatcgccggtctggccggcatgtccgaggtctgcggcatcacacaccgccttcaggccaatttcgcggcccaggtggggccgtcgggaatgaccattgcctacctggcccagtgccatccgctgggggcagtgctggtgtccttcctgttcggagcgctgcttgtgggcggcaataccatccagaagctgggacttccggtctccacggtgcagatgattcagggttccatcctgttctttgttgcggcgggaaccatgttcatgaattaccggattgtttggaaagaaaggtagggtttgtcatggtacaagtgattttattggcgacattgacggccgcagtggcccagggcacccctctgctcatcaccgcgctgggggagatcatgacgcagcgttccggcgttctgaacctggggctggagggcatgatgctcatcggggcggcggcgtccttcatcgcgctggtcaacaccaacagcctgattctggcggtgctcatcggagcgctgtgcagcggcctgctggccctggtacacgcgtttctgtccatcacctgccgggtccaccaggtgatctgcggcctggccttaaatattttcgcagggggcctaagcggttatctgggcaaggactacaacggcatcgcggcgcccaaggtgctgcccagcttccggattcctctgctggcggacattccctatgtgggggaaatctttttccaccagaacctgctggtctacttatcctacgccctggtgatcggcctgacctatatgattttccacacccagacgggtttaaagctgcgggcctgcggcgagaacccggcggcggcctactccatgggcgtggacgtcaaccgcacccgctatatctacgtggtgctgggcgggatgctggccggaatcggcggctccttcctgattctgagcacagtgcccagctgggtggaaaatatgaccggcgggcgcggctggatcgccctggccattgtcacctgcgccatgtggaagcccggcgcggccatggtggcggcctacgtgttcggcggagtggaggccctggcctaccagctccaggccgtcagcgtgaacgtgtccccggtgctgttaaaaatgatgccttacgcggccaccgtggtggtgctggtagcggtatccatcgctaaccgggacaagggagccgccggtccggaggccctgaccacgccctttgtggctgaggataactaggaggatatgacagatggaagaaagagaattgacagaacagggggaggcgttcatccgcggctggtacgcgcgcatcgacgccaaggtcccctttgaggagatcgccggggacacggcgggggagagcctgattgtggatttcccgggcaatcctttagatttttgtggatttaagagctggtatgaggggcagtgccgggattttacgggccggcatcagctccacaccgtacgggtgtccggcagcgacacggaaatggagattttttccgaaattacatggacagcggaaaagacagaggggggaacgctgacgctctaccccaacgtgaccctgaggctggttaaggacggcggctggaaggtgcgttattacggctgcgtggaccggaagtaagaataaaaaacagaggagttttaacgatgaataaaaagaaattcgacggcagtatcagtgagattatggtggcctacaaacccaacggggatctggacttcgggccggtgaagaagatggtggagttccaggttgagaaccacatcgacggcctgtttatgggcggcctttccacacagacctacctcctgagcatggaggagaaaaagcaggtgtgcgcggagctgatgaacgccgctgcgggccgggtgccggtgatgatgaatgtgatggaggactccatccgggatgcaaaggagctggtggaggcttacatggagatcggcgtggacgccgtgtgcatttcccagccctccgtgttcccctatacggagcaggccctgtatgagttttttgatgaggtgattccggcggaataccccacctacatctacaacgtgccccagacgggcaacaccctgtcgcccagggtgacggcgcgcatcgccaacgaccatgccaacgtgctgggctacaaggacagcacccagaatatttccggcctgcaggatctgatcagccaggtgaaaaacccggacttccagtacatcgcgggcagcgacgccatgacccttcccatgatggctctgggcggcgtgggcgtgatctccgctatctccgtgcccttccccaaggtggtgttagacattacggataagttctttgcaggggactttgagggcgcgctgaacgctcaccggttttccatgagcgtgcgcaagctgttaaagaccgccacggacatgaacggctactactatgcctgcgagctgcttggaatgccctttaacggcacccgcatgcccaaaaacatgaccatggtgacggatgagcagaaaatgatcatcaagaccgggcttcaggaaatgaagctcatataagggggcgggatatagtggacagacgggttgtagtgctgggcagttgcagcgtgtgtcatgtgttcgcctcgccgaatctgccgaaccggggcgagacggtgatcggggacgattaccacatcgtggtgggcggaaaaggttccggccaggccatcgtggcctgccgcctgggcagcgaagtgtttatgctggagcacctgggagacgacgcctacgggcgcagggaaaaagagtcctaccgggagatgggcatccatacggattacgtgtacctggacaaggactgccccaccggcaccggcggcattttcctggacgccgaggggcagaataaaattatcatcgtgccgggagccaacagcaatgtaagctgccgggatatcgacaatatgcgggaggtgctgcagggagcaaagattctggggacccagttcgaggttccggccgccaccgtggactacgccatccgcacggcggacgggatgggggtgcggaccttgcttgatcccgcgccggtgacggcctttgacgagagcctgtacccgcacatttccatcatcaagcccaacgagtgcgaggccgcggagctgaccggaatccgggtggaggacacagacagcgccgccagagcgggaaaatggttcctggacaagggcgtgaaggaggccgccatcatcaccctgggcgagaagggggccgtgctggtcaccaggcaggacgtgaagcatttcccgggcctgaccgtgaaagcggtggacaccggcggtgcgggcgacaccttcgcgggtgcgcttctggccgccctcagccgggactggccgctggagaaatccatccgctacgcccagtgtgcttccgccatctgcgtgacccgcaccgggtcctactccatgacgcggcaggaggaagtggaccggctcttcgccgagacctacgcctgcggggcggtgtgaggctgaacacaaggccggactgcggcggagcatccggcaaattgagataaggagagcgattatggaccgagagaatctatttcaggcggtggaccacaccctgctggcgcagaccgccacatgggaggaaatccgccggatctgcgacgatgcgctggcttaccacacggcctccgtgtgcattcccccttcctatgtaaagagggcggcggagtacctggccgggcgcatggccgtgtgcacggtcatcggattccccaacgggtatcagaccacggccgtgaaatgctttgagacaaaggacgccctggacaacggggcggacgagatcgatatggtgatcaatatcggggacttaaaggacaaaaattacgctgcgatcgaggatgagatccgcaaattaaaggaaatctgcggggagaaaatcctcaaggtgatcattgagacctgtctgctcaccgatgaggaaaaaatcaaaatgtgtcagattgtcaccgcctccggcgctgactttatcaagacgtccaccggtttttccaaggccggggcaacatttgacgacatcgcgctgtttgcggcccacgtggggccgggcgtgcgcatgaaagcggccggggggatccgttcctttgcggacgcggagaaattcatggagctgggagccggccgtctgggcaccagccggattgtgaaacttgccaaggcggaacaaaacagttgatcacaggccgcttcccggcggccatggccccacagcgggccggatcaagccggttgttctgccatgcgagcggcaaaatgaccggccccgcgggactgccgccccggactgagaccaaaacgggctcacgaagaggaggcggccgcgggaataaattcatactacctacctaccaaaatggagccgttcggggaacaatcccgggcggtttccgctttgtgcggtaaaacttgcaacccgtcttaaaaagctgtatactgaatggcataaaaaacacatgagaactgatactattagaaaagaggatacagtgacaaattcatacgttgcgatcgatatcgagaccacgggcctggagcccaggctggataagataacggaaattgccgccctgcgggtggtggacggggcggtggaaggccgttttgtgaccctggtgaacccggggcggccgctgggggagcggatcgtggagctgacggggatcaccgacggcatgctggccggggctccggccatcggggatgtgatcgggcctctggtgcgcttctgcggggacctgccccttctgggccacaacatcctgttcgactacagctttttaaagcgggccgccgtgaaccagggcctggatttccagcgggagggcatcgacacgctgaacctatgccgcgcgtttatgcccggggaacataagaagaacctcaccgccgcctgtgcattttactgcatcgagcaggtggaggcccaccgggcggaggcggacgccttaagcgcccatctgctttaccagaaattgctggagggccgcggggagggtagggaggagctgttcaccccgaaatccttgatttacaaggcaaaaaaggaacagcccgtcacaaaaaggcaaaaagaatacttgcaggatttaataaaatgtcatagaatagacgtaactgtgcagatcgataccctgagccgcaacgaggcttccagaatgatcgatcggattctctcacagtacggaagaaaggcaaagattaaagaggtgaatttacaatgattaacatgagcgatccgaagatgaagaagattatttccaccattattgtagtcgtgctggtgttggcgatgatcgtgccgatggcgttaagcgcgctgatgtattaagttacaagaggagcagttatgaaaaagagagtatggaagaacggcctcgctgctgtggccctgggtatggggcttctcgcggcaatgccgtccatggcgttcggcgcccaggtacttccggagggactgtacgtgggtgagcagagcttgggcggcatgactgaggaggaggcggagaaggcagtgcaggcctatattgacaacctgaccgcgctgcccatatccgtggatatagatggaaccacagtggagactaccaccggggagcttgggcttacctggtccaatcccgatgtggtgaaggagactgcggaccagtacgagtacggaagcctggtgaagcagtatatggcgcggaaggatctggaacagtcccccgtgaaactgaatcttgaagttcagaccgatcccgccagagtaaaagcgtttgtggatgagaaatgccagggctttaccgcccaggctcaggatgcttccatcacccgggagaacggccagttcgtgatcacggattccgtggtgggagtggcggtagacacggcggccacggaggcggcgttaaacgaggccatcacggcggcgctggcggatggcggcagcacgcagattcaggtggcggccgcggtgacggagcagcagccccggatcaagaccgaggacctggccaccatccaggatgttttaggcacatttacaactgatttttccagcagcggcgcgtcccgctccaccaacctgacggtgggggcggccaagatcaacggccatgtgctgatgcccggggagaccttgtccggttatgaatgtttacagcccttcaccacggccaacggctaccgcacggcggccgcctatgagaacggccaggtggtggacagcgtgggcggcggcgtctgccagatcgcgaccactctgtacaacatggcgttaaacgcggagcttgagatcacccagcggcagaaccactccatgatcgtcacttacgtgaagccctccaaggatgcggctatcgccggtacctacaaggacatcaagttcaccaacaactacagcactcccatctacgtggagggctataccgagggcaggaagctgacctttacggtgtacggcaaggagaccaggcccgcgaaccgcagggttgagtacgtttccgagactctgggcaccaccagccccggcgagcctcagcagatcgtggacaattctctggcgcccggcgccagggtgaaggtgcagtccagccacaccggacttcgctccaggctgtggaaggtggtctacgtggatgacgttgagacggagcggaccttgctgcacacggacacctataacgcgtccaaggctatttaccgcgttggcccggcagtgcctgcggaagcgccggtggagacccctgcagcacccacggagacgccggtggttgaacctgtgaccggtgtggacggaggtcccggcgtatcgccggcccccagcacggaaccggctcccggcccgagtcctgatccggcccccgcggccgatccggcgggccagccgggaggtccccaatgaggacagccggacagggcccccgcggctttaaaagacgcgacggtgaaatgagacccggacaggacttgatcatggcgggatacgccggtctggacggcgcctgcggcattgcccgggcgcgccgggaggagctggagcgcagattctgcagcgcgttcttaaaacagctggccggttccccgggaccttcgcccgttatatgggcaggggaacacctgggagcggatataacagcttatgaagtattgggagagggcggcgtattagctgccctctggaatttatcaggggtttttaacgcgggcatcgaattcgacctgcgccggattcccatccgtcaggccacggtggaaatctgtgagctctacgggctgaacccctaccggctgcgctcgggcggaggctttgtggccgccgcggacaacggagggcgggcggtgcgcgccctggaggctgctgggataccggccgcggtgatcggaagcgtgatcccgggaacggcccgcaggatgagccacggcggcgagagcgccggctttctggagcggccccagccggatgaatatgataagatatgcggcgatgagcggcagacatagaaaagaggagaggaaattatgagagaacgtatacttgcggttatggagaaaaacagcagaattgatataaaagatctggcgatcctgctgggcgagagcgaggtggcggtggccaacgagatcgcgcagatggagaaggagcacattatctgcggctatcacaccctgatcaactgggataacaccagcgacgagaaggtggttgccctgatcgaggtgaaggtgacgccccagagaggcatgggctttgacaagatcgcggagcggatttaccagttcagcgaggtggaggccgtgtacctgatgagcggttcctttgacttcaccgtattcattgagggcaagaccatgcgccaggtggcgcagttcgtgtccgagcgcctggcgcccatggagtctgttctgagcacggcaacccactttgtactgaaaaagtataaggaccacggcaccatcatcagcgatccggtgcaggacgaaaggatgttgattaccccatgagaaatccattatccgataaaatcgtgcagatccccccttccgggatccgcaaatttttcgacattgtcagcgagatgagcgacgccatctccctgggcgtgggcgagccggattttgacacgccctggcatatccgcgaggaaggaatctattccctggaaaaggggcgcactttctacacctccaacgcgggtctgcggcctctgaaggtggaaatctgcgagtatttgaagcgccgctgcgacgtgctttacgacccggatcacgaggtgttagtcaccgtgggcggcagcgaagccatcgacatcggcctgcgcgccatgttaaacccgggcgacgaggttttgatcccccagcccagctatgtgtcctacatgccctgcgtggtgctggcggacggcgttccggttgtcatcgagctggaggagaaggatcagttcaagctgaccccggaaaagctgttggagaagatcaccgacaaaaccaaaatcctggtgcttcccttccccaacaaccccaccggcgccattatggagaaggaagaactggaagaaattgccagaattgtcattgagaaggacctgttcgtcatctccgacgagatctattccgagcttacatacagccagcgccaccacaccatcgctgcgtttcccggcatgaaggagcggaccatcctgatcaacggtttctccaaagcctatgccatgaccggctggcgcttgggttacgcctgcgccccggccaatattctggagcagatgttaaagatccaccagtacgccatcatgtgcgcgcccaccaccagccagtacgcggccatctcggccatgaaaaacggcgacggcgacgtggctatgatgcgggagtcctacaaccagcgccgacgctacctgctccacgcctttaaggagatgaatatcgactgcttcgagcccctgggggcattctacaccttccccaacatcagccggttcggcatgagctcggaggacttcgccaccaccctgttaaaggaggagaaggtggccgtggttcccggcaccgccttcggcgactgcggggagggctttgtccgcatctcctacgcctactccctggagagcttaaaggaagccttaggccgcatcgagcgttttgtcaggcggcgtgacggaaaggcgtgattcacatgatgaacgttgtacttctggagcccgagatgccggccaacaccggcaacatcggccgcacctgcgtggccaccggcacccggctccatctgatcgaacccctgggctttaagctcagcgagaaagccatcaagcgggcgggcctggactactgggataagctggacgtgcaggtctacgccgattaccaggactttttggaccgcaatccccaggcaaagggcaatctgtattttgccaccaccaaggcgcaccagctctacaccgagcccgcctaccggccggactgctatctgatgtttggcaaggagagcgcggggatcccggaggaaattctggtggccaacgagccctactgcgtgcggattcccatgtggggtgaaatccgctccctgaacctgtccaactccgtgtccattgtgctctatgaggcgctgcggcagaaccggtttggggagctcaacccggcggggcagcttcaccgcctgcactggaacggggaaacctgataacaccactctgtaaacacacccatacccaacgcggggcagacgcgattttggaccagtccggaatctccgtctgccccgttcttttgatgccgccccgtcccattcaccactattcgctcatattctttctgttcccttcataccctagaagtagctgaaacggcacttcccgtttcgactagttagagtgtggaggggttgaaatgaacgagaagtatgtggaagcgctggaacaatatgaactggaaatcttttccgtccgcaagggacgcgggtcctggatctgcgagacggaggacggctgcaaattgctgaaggaataccggggaactgtaaaacgtctggaatttgaggaccaggttctggaccagttggataccggcggcgcactgcgggcggaccgctatgtccgcaaccgggagggcagccttctgtccatcgccggggacgggacgcgctatgtgttaaaggactggtttttggaccgggaatgcgacttgaaggataaccgggagatccgtctggcggcctcccggctggccatgctgcacaaaagcctgcgcaaagtgccgtttcaggaggagtggaacatgggctccatcctgatcgaaccgttagagaccgagctggagcgccataaccgggagctgcagcgggccaggaactacatacggggcaagcggaaaaagtccgaattcgagctctgcgtgatcggcaattacaatatgttttatgagcaggcggtccaggcggtggagggactaaaggggctgtgggaggaaaccagggccgcatccctggacggtgaggactcaaaacccctgtacctgtgccacggggacttggaccagcaccatctgctcatgggcgacggctacaccgccatcatcgagtacaaccggatgcatctgggcgtgcagtccacggacctgtaccgctttatgcgcaaggtcatggaaaaacacaactggaacgtggacctgggccgctccatgatggatgcctacgagcgcgtgctggacatgagcgccaaggagatgcgctgcctgtactatatgtttttgtatccggagaaatattggaagcagatcaatttttactacaacgccaacaaagcctggattccggcccgcaatattgaaaagctgcgcagtctggaagagcagcagccggtgagaaaccgttttttggaacagatatttgcgggggtataaggcgtctgaactgttacacatgaggagcgtaccggactcgcgggggcgaatttgtacttcctttttctggtggggtatagtataatcataatcagaaatacccagcggaaaggctgaaacagaagggagtatgatgctatgaaggattacatgaaaatctatgaagagtggttgaacaacccctatttcgacgagacgaccaaagaagagcttcgcgccattgcgggcgatgagaatgaaatcaaagagcgtttctatatggacctggagttcggaaccgccggcctgcgcggcgtgatcggcgcgggcatcaaccgcatgaacatctatgtggtgagaagggcgacccaggggctggccaactacattatcaagcagggcggcgcggataagggcgtagccattgcctacgactcccgccgtatgtcgccggaattcgccatggaggccgcaatgaccctggctgccaacggcatcaaggcttacaagttcgaatcccttcgccccaccccggagctgtccttcgcagtacgcgagctgggctgtatcgccggtatcaacatcaccgccagccacaacccgccggagtacaacggctacaaggtatactgggaggacggcgcccagttcaccccgccccacgacaagggcgtaacggaagaagttctggccatcgaggatctgtccacggtgaagaccacggatgaggccagcgctgttgcagccggcctgtaccaggtgatcggcgccgacattgacgacaaatacatcgcccaggtaaaggctcaggtagtgaaccagcaggccatcgacgagatgcaggaccagatcaccatcatctacaccccccttcacggaaccggcaatatcccggccagaagggtgatgaaggagctgggcttcacccacgtttacgtggttccggagcaggagctgcccgacggggagttccccaccgtcagctaccccaaccccgaggccgctgaagcctttgagctgggactgaagcttgcccgggagaaggacgcggacctggtgctggccaccgatcccgacgcggaccgtctgggcgtgtacgtgaaggacgccaaatccggcgattacattccgctgaccggcaacatgtccggctccctgctgtgcgagtacgtgctcagccagaagaaggccgcgggcaagatcccggcggacggccaggtgatcaagtccatcgtctccaccaacctgattgacgccgtggcgaaggcctacggcgcagagcttatcgaggtgctgaccggcttcaagtggatcggccagcagatactgaaaaatgaggccagcggccatggcacctaccttttcggcatggaggagagctatggctgtctgatcggcacctacgccagagacaaagacgccatctccgctaccgccgccctctgcgaggccgccgcttactacaagaagcagggcaagacgctgtgggacgctatggtggacatgtatgagaaatacggctattacaaggatgcggtgaagtccatcggcctgtccggcatcgaggggctggccaagatccaggcgatcatggagaacctgcgccagaacacccccaccgaggtgggcggctacaaggtattgtccgcaagggactacaagctggacaccgtcaggaatatggagaccggagaggtgaagcccaccggacttccggcgtccaacgtgctgtactacgatatgaacgacggcgcatggatctgcgtgagaccttccggcaccgagccgaagatcaaattctactacggcatcaagggcgggtccctggaagacgctgaggccaaggcagccgcgctgggcgaggccgtgatggcgatggtggatcggatgctgtgatgacatgacagaaaagggtattgcagagggagaacggttagaactctctgcaataccctttttatagcgccaatattgggcgttccgaatctaatacgcggcttcaaaggaagtgtatcagtccatcgtctccggctttccgtccccgtccttctgcctgcgccccgcattttcccgtagctcctttaaagcctcgctgaagcgggaggaggaggcggaggggttgccttttaagaggctgcgccggtagaaatccatgtgggaggagagctggcgccgtttctcggtgagagcggtcagacgctgggacagagcggccatgtgctcccggcgttcccggtccgcagcctccgcgttggccgctttgtccacggcaactccgtcgggaattcccgcctgatcgtccgcctgaggcgtaccggcggtggaatccgcctgtgcccgctgggccaggacgcttgaaacccgggccgcggcgtcctcggtgagagaggacaggcgttccgctgtccgggccaccttgtccgcggtgtcctccacgaactcgcccatgcgttccgcggtgtcctccacaaactcacccatgcgctccgcggtatcctccacaaactcgctcaaccgcgccgccttgccctccatgcggctgacagtggattccccgatggctccggctttcgctgccgcttcggatttcaacagatccaggcgctgcgccgcctcatcccgcgcctcggacacccgtttgctggtctcgcttttgagcagggccatctgcacctggatatcatccagctccgcgcgcattttggtcatggcatccagcaccttagccagatccagggccgcccgcacggactgcacggcatccgccgtgaacatgacggtaacggctcccactgtgatcagggcgggaatggggtggagcagaagtaccagccgggagatgggcgggtgtacgatctccgtgaggaaaatagtaagaaatccccaggccacggaggaactcaggcagatatacccgttcagattaaagcgctggttgctgtaatcccagtatttcattttgaacagccgttccatggcccagcccgtgacgtattccagtaccgtggcggcgatcattccggaaatgtacaccaggaacacgttgtgttccaatggcagagacacccacagcatcataacggctccggtgccgtaaaggggcagcatgggaagccgcaggaaaccgcggttcacaaaccggcgcgtcttgcacgacacgtaggtggattcgaaaatccagccgaaaaagcaataagtgtaaaagatcagcagccattggtaccaggtgtaagtgtacatattgattcttcctttactcagtcgattgaaaatgctgttattatcatactgtgttttggcaaaaaaagcaacgtatgaccgcgggcggggtagaactcaccagtctacgacccggttgaaaagaatagcctgctccgtactggtccgccgcaggtaaatgtgggtggtctctatgctatcatgcccaagaaggtctgagagaaatgcaatatcgccgccgttttcgataaaatttttggcgaagcggtggcggaaggagtgggggtacatgacttccgggtccaggtgataccggatggcaaaggttttaagctgtttgcggattccggaaacggttatggggcggccaaggcggctgataaaaagagggccgtctcgccgtccctccgccgccagccagtccaggcacattttttggagggaggaggggatgtaaatccgccgggtcttatttcccttggagtagaggtcccggtaacccacctgcacgtccggcaaaaccagtgccaccagctcgctgacccgcacaccggtggcggcgatgaagcgcacaataaaatagaaggtgtactgctcatcctcccacagcctgtttttcagatactcatagtccgcctggctgatgacgtggtcgatgaaggatttttgctggaggcggacggaggggattttatagtcgtggatgtcctgggatttcagaaaacagttcagcgcgcggatgcgcatgttgacggtctgggggcggtagcgttccatcaggtagactttgtaaaggcttacgttattctgatccagctcagggtagcgggagaaaaaggttttaacaccatagacgtaggacaaaatggtattacctgacagatttttcgcggtcatgtaccggcggaaggttcccagcagcgcttccaggtttccctgtgggaggatggaggcgggagggggattagaggaggacatgcccatatgtatttgctccttttttcgattttacaacgtagggtgctctggcgcaaccagtggataaaagaactgcaccataacggttttacagttatggtgcagcacttattagcaattagaatttctaatcgttttaacgaaaattagttttccagaactaccttggtgatctcgtaagagctgttgacggagaacttatagtcatttccgtccttggcagagctcttgcccttggcaatggtgccgttgcttccgactaagtagtattttgtggtagcggtatcaagcttcgcatcttcagcgcgggtccaggttacgtcgccgtcgctatttgtggttctgataaagctctcgtcatcaacccgctccctcaagaatttgggagtatcgattttttctacagcgattgctttaccatcctggaagcttactttatagatgctgtacttgtcatctttatcagcctttacctgtttgcctgccatgtatagcttcttatcatcgacaccaacatagccggcacctttcagagctccggatttattgaatttgaatgtaaaggaatctccgtcaatgtttacggtctgagtgccggttctcatggcgccgtcatcgccgaagtagtagcatctgagagttccgtcagcaatttcccctttatattcatttacaaattcatcgaatgcgtcctcggtatcataagcaccggttgtcgcagcctttttgttgtcctccaaagacttcgaggaatccggcttcttagcatcatccgcaaatttcatctcgatattgacggattcgtcatcgccggtaaagctcaggaacgctaagccggtaatattgcggccatattcatcaaaggcatactttttgcccttgatcgtccggatttcattcgcatacaggttaccatttccatcggcgtagtaccaatactcatccccgtcatcgtatttgccctgctgcagataataaccgggtacaaccttaaaccattctttcgtgtaacgagcgccgctttccggactgttaaagtacaggaattctttggtgtagtcagtcgcaccctgtatcatttctgtaccggcagcaacaggagaagtggccttggctttcgaggttgtagcagttgtataccaggaggcgatcatacggccatcctcgtcaaatccatatttgtggccatcaatggtcttatttgtcttatcagtctgttttttgccggagggtttaaaccagaagtaacggtcctgatcttcatcccaagtgtcgccaagcggatccggctgatcggactcgtagttgctatccgtaatgctgatcagtctccagccagtggccatagcaccgtcatcttcatcgccgaaatagtaatcacactctgaccaagcctcatcatcagtctgacgcacgccatcttttacccagccgaactgcatcttaccttcatcgtcaaacgtatattttttaccattgataatcttcagagacacatcgccggtggcgttatcactccgcttataggcttttccgttggcgccaaaataataccaccaatgctccggctcatcttcctcgccggcatcttcattctcaatcgctacccactggttggtcgccataacaccgttgacatctacgtagtagtagtcatcatcatcctcaaccagcatatccacagccatctcgccgttgtcgtccaaccaataccagttggttccggatttcttccactcgctctctactctgtcgccattcttgtcataataaacccaagtcccatcttcctcagcccaaccctgagccgcaaaagaggtcatggatgcaccaatggcgagcagtgctgctgtggataatacagcaactaattttgtctgctttctcataattaatgcactctcctttttctttttgaaatactttttgaaattcctaattgcattacgagttgattatacttccaataagggaaagtatgaggagttgacggtagagacgcgtttgcacaacaaaaaaagagataaaggcttgccgtgtgggatcacgtcattgctcgcctttatctctttctttcgcaggctcagcgcctgcgtgggaatggtaggtatattatagtttgtaaaaaagaaaatgttgataggggggtcggacggttttacccgtccgatatgagtatgaaaaagctttctttgctttacatgtattatcataccggaaaaatgtgaggaaaatatggacgttccatgaaaaaaagataaaaattattaggaaatcatgaaagacaaacggtcaattattatggaaatctaaaaacaaagcgggccctgtcccaataaatgcatacaatctaaaaacatgtcgatgtacaagcccggacggcaaatgataaaataaaaacagaacgtaacagaacatttcaccgaggccaacgtgaatcgtaaccggccggcatgagaatgtgccggcctccacaaaaacagacagggagaggtatcagatgagaaaaaatatgaaaagggcaactgcgcttttgattgcggccgccatggccgtgggcctgtcggcctgttcttccgggggaggcggggaagcgaaagcgccgtccgggactcagaccgcagattccgcggattccgggaccacggcagagcccgcagaggacaagaaggaggccgcgaaaaccgcctccgatgagaaggtgaccatccgcttttcctggtggggggccgatacccgccacgaagccaccttgaaggtgatggacatgtacatggaaaagcaccccaacgtcaccatcgagggggaatacggggcgttcgactccttttatcagaagcttcagacccagctgggcggaggaacggagccggacatcatttccgtggattacaagtgggtcagcgacctcaccgcccagggcgaactgttcgtggatatgaacagcctgacagatcaaatcgatatgagcggattcgacatggattttgcgaaaatatacggggccaaggacgattacctgatcggccttccggtgggaatcaacggcatgggttacctgtataacgtggaatttttgaaacagtacggcgttgagccaagtgacgactggacttgggagactgtgctggagaacggaaaaaaggtgcaggaacaggacccctccaagcacctcatgtacaatcacgcggatcactgggtttacatggtaaaggcgatcttaaagcagatgaacggccagaacctggtgaaggacgactatactccgggctttaccgccgaggagatggcgaagatcttcgactatgagagacagctggtggagaccgggaccgtgcctccttttgcagagggcgtgctctacgagaccgtgtatgcggaccagaaccccaactggttgaaccaggatctgggaattttccccacatcctcctccctggtgcccggcatcgccaaggccagcgatttcgagctggcgaccctgcgctacccggtggcaaaggacgctgtggatcccggaatcctggtgaccccgtcggtgttcctcaccatctcggccaacagcaagcacccggatgtggccgcggactttatcaattatatgctgaatgatccggaagccatctccgttctcaaggatacccggggaatcccggccaacgagacggccaaggagcagctggtggaggaaggcgttatcgacggaaaggtctccaccatggtggcccaggccctcagcggtgccggagcggcggagaacgggcccagcctgaactcggaggtcctggtgctgttgaaagactacatccaggaggtcggctaccttcagatgaccccggaggaagcggcggccgaattctggtccgagctggaagcgctgctggaaaccatcaaaccgtgaggctgaagccgcggctttgcagtgcgtaacctgaaaaatagagacaaaattgccaaggggtattgccggatcgatcaaacggacgcaataccccttcctgttgaacgagacaagttgccggggcggcccccagcggcctgcgccccagccctgccggggccacggacctgcccgcgccacgtcccagcctgcgccacgtccctgcccgcgcctactggggccgcccattaccctgcgcggagtctccggcgggcaccccttgtacacccatcattcaaccgcaccacccgacgattaggagatgataagatgaaacggacagaccaccagcctgtggcgtacctgtttatactgccctggatcattggattctttgtattccaactttatccctttgtggcttcctttgtgtattccttcacggatttctcgctgttaaagtccatgaaattcgtgggctttaaaaactacgtgcagatgttcacccgggaccgggtgttctacaagtccctctgggccacggtgaaatacgtgctgatcgcggtgccgggcaagctggtgtttgccctgatcatcgccatgatcttaaatatgaagctgaaatgcatcaatttttaccggaccgtctactacctgccctccattctgggcggctccgtagccatctcgatcctgtggaagttcctgttcagcaaaaacggaaccgtaaacacctttctggcccatctgcatatcccggccctggactggctgggaagccccaatctggcgttagtgaccatgggacttctggtggtgtggcagttcggctcctccatggtgctcttcctggcggcgttaaaaaacgtgccagcggagctctgcgaggcggccagggtggacggagcagggcggatccgcacgtttttcaccatcaccctgccgctgctcacgcccaccatctttttcaacctgatcatgcagatgatcaacgccttcaaggagtttaacgccccgtttctgatcactaagggagggcccttaaactccacctacctgtacggcatgatggtctacgagaacgccttccagcactctaaaatgggctacgcgtcggcccagtcctgggtgctgttcatgatcatcctggtgttcacggccctcacattcaaatcgtccccctactggacgttctacgaggacggaggtgaattctgatgaaacgcacgcacagacttgtgattacctacggtttgctgaccgtcatcggcatcgtgatggtctaccctctgctttggatgatctccgcgtcctttaagaccaaccgggagattttcagctccctgtccctgatgcccaccgagattctgtgggacggatattccaaaggctggcagagcagcggacagtacacctttgccacctactttgccaacacctttgtcatggtgattcccaccgtactcctgacggtggcctccagcctgccggtggcctacggttttgcccggttcaggttcaagggcaagggagttctgtttaccctggtgatcgcctccctcatgttgcccacggaagtgattatcatcccccggtacatgctgttcaacaaactgggctggctgaacacctacctgcctttcatcgtgccggcggcatttgccacctattccttctttatatttatgctggttcagttcatccgcgggattcccagggagctggacgaggcggcgcgcatcgacggctgcggtccttggggcacgctggtgaacatcattctgcccctgtgcaagcccgccctggtctcctgcgtgattttccagttcgtttggcgctggaacgactttttaaatcccctgatctacatcagcagcgtgaaaaaataccccctgtccctggccctgcgcatggctctggacgtaacggacacggtgagctggaaccagaccatggcaatgtcggttctggcaatggttcccccggtggccctgttcttcctctgccagaaatactttgtggaaggcgtggccagcacgggactgaaaggatgatggaaatggacggacagaatcaaagctttgaggtgcgggcgctggagttgcacagccagtacgcctgggactacaactggatcatcaacaccatggattttatgaaggatttagatttcaacaccctggttctccaccgcaatgattttatcgacctgatcatttacccgggaaaatacttcgggtacgaggaaaaggccggggacacgatctttgagacctacagccacatattccgcaagctctaccggtacacccccaccaggcgttccggcccctaccagcgccgggcgttcttaaagcgtgtgctggagcaggccaaacgccggggcattgacgtgtacatcgagaacaaggagttgtatttccccgacattctgctggaattttaccccaatctggtccacgacggccacatttgtgcaacggaccccttctggctggaattcctccaggtgaaataccgggactttttccgggagtttcccgaggtggcgggaatcatcaccgccccggccaccggtgagagccgcgtctccatcaaatccaaccgctgccagtgtgagcgctgccgttgcgcccggaaggaggactggttcgacaatgtgctgcgggccatgtacgcccccatccacgaggcggggaaaaccctggtggtgcgggacttcgtgttcgatccacaggcccacggcgagattgcgggggtgatggagcggttgccggaggacgtggtcatttccctgaaaaatacaccccacgactattaccccacgttcccggacaacagccggatcggaaacgtgggaaatcaccggcagtggatcgagtacgacgccatgggccagtatttcggctggggtgttgccatggcggacttaaccggggattaccgcaaacggatgtgctacgccagggaaaagggggccaccggtgtggtgatccgtacggactgggagagcctggacggccacacggcctttggaacgcccaaccggatcaacctctacgccggagccatgctggcggccgatcccggcgtttcggaccgggacatttacctgcggtttctgcggtctgaaaactggctgaaggacggccttatgcaggaggagaccggcgaggccgcccggtggttcggccgtcttatgggcggggcctgggaagccaccaggcggatgctgtacgtgcagggctgcgtattctcggattccagcctgatgcccgtttccttcgcccatgcgttctggctggcggaggagaaaaactcgctgaaggcctgggacccctctaaggcggacgccctggcgccggaccgggaacacctggaggctgccctggcggagaaaaaggaagcggtggagcgcgttaccgccctgtgcgccctgtccggggagcctccggcggggatccggccggaaaaagccggagaactggcccggcggtttgggatttaccgcgaatacgcggaaatgtacgcggccgcagtgagcgccctgatgctcacccggtacgtgcgggagacggaggaggaccggaactccgaatattaccgggcgatctgttggaagcgccgccaggcggtggaagccctggcggactgggagatcaggctgcggcgcatggctgtggagacagattacacgcctcacacggtgtatacgctgatggacggggaccggatgcgctgcctgtaccgggatttgagagaggaggagacagatgagatcggttgaggaaatgtttcgggtggacgggaaaatagccctggtcaccggcgccgccgggggaatcggcctggcctgcgccaaagccctggcgtccgcgggggcggatctgattctggcggatatcgacggcggacggctggacgcggcggcggaggagatccggagggagaacggtccgtccggggggcgctttcttacagcggtctgcgatgtggcggatatgcggtccgttgagacgcttatggaacaggcgcgggaattcggcggcgtggacattctgattcacagcgccgccgtcaccaaccgcaaacagctgttggacatgaccgaggaggagtggaaccacattctcaccgtaaacctaaacggcgcctatcacatggggaagcaggtgggggagctaatgacccggcagggccgcggtgggaaaatgacctttatcgtgtccaccggcgcttaccgggcgggcgtcaacttcggagcctacagcgccagcaaggctggggtggtgatgatgatgaaaaccctggccctggagctggcgccctgggggatcaacgtgaacgccattgcacccacggccacggagacgcgtttcacggaggagtattaccgggagaatccccaggcaaaggagcgggcgcgggccaatcacccactgggccggctgggccgggcggaggactacatgggcacggccctgtatctctcctccggggcctcggactttgtgaccggcgcgctcctggtggtggacgggggcaaaacagcaaaatgattggggaattctggaagatacgaaggcttgcgcgcggcaaagcgcaggtattataatagtctcatgacaatggataaaggggcgggcgtatgtatcagatgatcgtggtggacgacgaggcggagctgcgggagggaatcagcaactatttcccctgggagagcttaaatatccgggtgaccggaatctttgagaacgggcggacggcctttgcctatctgaaggcccatccggtggacatcgtactgacggacatccgcatgccgtttatggacggcctggagctgatcgagaaggccaaggcggtgtccccgtccacctgttatgtgatcctcagcggctaccgggaattcgagtatgccaagaagggcctgcttttgggggtaaaggactacatcctgaaacctaccaaatattcccagatctatgaggtgttttcccgcatcaccgcggagctggaccacagcgcatcggcccagcggcaggaggaaaatctgccggatcccgagcgctccgtgatttccagcgtgaagaaatatatccgcacccactatgcggaggtcacgctggacggggtggcggagtacgtccacctgaatccctactatctgagcacatttttcaagcagcagaccggggaaaagttttccgactatgtacagcgggtgaaaatggaagccgccgccagcctgctggagcggggcggccagaacgtgaaagaggtggcggaggcggtgggctacaccaatcccaacagcttcacccgggcgttccggcaatattaccagtgcaacccgaaggactaccggcgcatgaagcaggggctgtaatcaggacagggaggacattgccatgaaaatgaaatttttccgcaagaccctgtcctttttcatcgtgccggtgatgatcccgatcctgattctgggcacactctcgggcatcaccctgaaccggtacatgcggcagggcatcgacgagcgctacgaggaccggctggagagccaccggaccaggatcgacgccatgatgagcgagctggactggctgaatatgaatctcagcaacaatcccagcatccagttccgcctaaaaaacatgatcagcaaatgcaaggacgggattccggccaacacctacgacgagatcaacaccatcatggacctgctgtacggctcctacaacgccaacacggcggtggagtctatctacatctattttaacaacgcgggccggcagttcatcagcagcaacaaccgcatcaccaatctggactatttcttcgaccaggactggtacgacagctaccaggcccacatcggcggtccggaacagacatggagcgagttccgcaagatcgctccctacaactttgcaggctccacccgggagatattcaccatctaccgcaagatcttctcgccggggaagcggaccccggagggcgtgattgtgctgaacgtgcggggagatcatgtcaaccgcaccttaaacgaactggtgggcgaggagaaccacctgtttttcgtcacggatggggaagggcgcgtgattttccgcaaccggcaggcgggcgcagagcgcgcggaagcggttctggcggcgggaaacgcgcgggaggcccggattacggggcagggaacctaccgggtctaccggcaggagtccggggatctggggtggaactactgcctggcggttcccggcgaggtggcctaccaggttcccaaccggctgacccggatggccgccgggctgatctgcctggcgctctttttaagcacggtcacgtcctatttctttgcacgcaagaattacaagtccctgatggggatcgtggatattttcgacaaggccacccacggacaggagcttccggcgctgtcgcagcggaccaccgacgtttacaattacattctctacaatatcgtggaaaccttcctgcaaaatgatttcctgcaggtccagctctcggagcgcaggtacaagttaaaggccatggagctgatggccctgcagtctcagatcaacccccactttctcatgaacacactgcagactgtgtactggcggtgtatttccctgacccagggcccaaatccggccacggagatgctggaaaacctgtccgaaatcctccactattccctggaatccagccaggagctggttccgctcaaggaggagctgaatattacccggtgctacctggacatacaggtgcagcgctataaaaatcagttcgacgtgatctgggacgtgtgggcgcccatggaggcggtgatggtgcccaagctgatcatccagcccctgattgagaacagcatctaccacggcatccgggacaaggcgggccattccaccatcaagatcaagatcggctccagggacggctgggtggcgatcaccgtgctggacaacggcctgggcatggaccgggagcggttggaacagctgaaaaagcggctggagggggaggacacccaggaaggcgtgcacatcggcctgctgaacacccacaaacgtctggaactgatctacggcggggactacaaaatacgcctcctgagccgcccgggccgcggaaccatgatccaactgaaaatccgggcgctgccccgggaagggtaaggcgcgggggcgttatcgcaatcgaaggctcctgttttgcgttttcagaggccggagcggatttgccggcaggttgaagggcactcagcgaaaatattccgaaaagttttgaatcaggtattctttatgctataatagaaaatatttggcggtgataaaatcctttttccagatggaaatccctatcacatcggcatttctgttatatgagaaaacgttctgcaaaaggggaaaatggcgcccaggcggacaaacaggagagatagaggatatgaaaaaaaggggatcccttggtttaatgatcgtacttattttaatcggtatttttgttggtataattggcgggacctttttgaaatatgaaattggtctgcgaaaaaatggtttgaaaatagaggcttttattgtggggtgggaagaagcttactcggatattgaagattctatggggcaccagcgtaaagaaaccagctactatccggtgctttcttttcaaatagaaggtgagaaaatcataaagacatcgaatgtcggaatggattacgaaacctatcaacagtatgagataggcgatatgatgacggtgcgttggtcggaacatgatgactatttaagctggtccggcagtatatcgggtatcataattccatcgattgtcttgtctgcggggattctgtgtatgctcattggcatcatatgctaccggccccggtgatccgggtctaatgggcgcaagcttttttcacgcaatttccggtttatcaggctgatttaacaatacaggcaatcaaaacagaaaattttgcagggccgtttttggaactggctaggagcatatgtacatgatggatcgactaaaaagaatcagaacgaacagcagaatatggacggcacggtttctgattgtggcgctgctcagcttttcggcggaaacgctgagcccaatccgggcctcggcttcccaggcgtctcctgaaaatcatggggacagctttccggcagaatatttctccggtcagggagagatatgggagaaactggaaacgaacggcgaggttatggtcgcatttccaagccagattgaggcagacatatcttctccggacgatgaggaccgctattccttcgaactggaggaagaaagcgatttgacattgtcgctggaatccgaatacccctgcactatggaactgatgtgtcaggggcaggtaatcggcgtttccgaccggccctacagccagattctggaaccggacggactggaagcgggaacctatacggtgcgggtcatcccccaggagcatgtggatacatccacctacacactgcgcatttcccgtcagagcgaccggaaaaagcagccggactattcggaggcgcacattgccggaacgctgtttgatcccaaatccccattccgggcaatcaatattcagagtgaggaagagaaaaaccggggcggcagcccgattatggcgattcactacctggcccactggcaggggccggtggatgaatcggtggttccctattacgataaaggtgattttagtgaggttcccagcgattacattaagtataagaaagcaaaaccaaacttccacgtacagaatgcggtcatattgccgggatatcaggaaaacggtgtgcacatggagcactggaagaacgcgattatgacttatgggtcgattgataccggattttttaccagttacaatttcagggataaaaatgaaggtcccggttatccggattgggattttgagtatttttatgtgccgaaagattggaattacgagaaatatggaggtcatgccaccttgattgtggggtgggatgataccgttgaacgagaaaaattccgtgttacggaaagagacgaatctggaaagattctcgccgaggctatgccggaacaggacggagcatggatttgcagggattcctatgcgggattgctgccggattatttttatgtttcctacgaatctcaggatttcggaggcccgtcttttgtgcccacagcctttgctcctccggagcagagcgataactataaccacctctacagcaatacttccggtggaatgatggatgtagcgtccaaggcccgcggctttattagaggcgtgcaggcttttcaaaatgaaggcggcagcgaactgttgagggcagttggatttgctacaggacagggcgagatttcttatgaaataggggttcgtataggagatggcccccttgacagggttaagaccggttatctgaaatatcccggtttctatacagcccgcctggaccagggaattatgattccccccggtgcggatttcgagatccatgtggccctttccggtgatgatgataagctgatgtcgttttatacatgccagaatgtggagggctggatcaacgggatcaaggcaatccctggaaaatcctactattatacggactgggatggccagtcggactgggtggatgcctccgcccagggagaatacccctgcattttcgcatatacatattctccgatggaccaggagatcaccattttggacaacagggagccggctggagaaatcgggaaagccacggcctcggaggcggaccgggaggcacagaaagccaccgcctcggaggcggatcaggaggtaaagcatgccaccgcctcggaggcggatcgggagatacagcgggccactgcctcggaggcagaccgggaactacagccgcccaccgcgccccagacggaccggaatgcaaaccgtgccgccgcttccgacgcggaggcggggattgagaaggccaccgcctcccaggcggtccccaggtatgataccgcatccgggagcaacgccgcaaaagcggaggaagacgccgaagacgaagaaaacgagtgggaggatatcgttctgttcgatgacagtgaggaggaggcggctgaggcagaggcaaagcgggtgaaggaacagaacttctggagaatccgggaggcggagtccggtgcgattccgaatgacaacccaaatgagtttgaggtcgatccgctgaaccttgattttccggccaaatacgattccagggactaccacttagtaacaaaggccaagaaccagggaaacagcaatctctgctggacattttcagcagcaggcgcactggagaccggttttttgagatatgggaatcagatgatcgactaccccagaggattaaatctcgtatcccgggattatccgattgtggatggaaccatctcattgaaactcagaaaaggggaggaaatccctctgaacctatcaggcgccctgtattcggaccgtgaatcgttcaatcccggaagtccccagatctattgggagatttccggcgatttgggaagcgtggaggaaggaccgaaactgtccgaaagcgggcagacattctgcacgctgaaggcgctggggccgggccgggtaaccgtaaccgccgtcagcatggcggacgtcagcctgagagtttcgtgtcaggttgagatcctggaaatgctgccggccagagtccatattgaaccggaaaccatgacgctggaggtcggggagatcaggaatctgaacgccacggtggaggccgatgaagaattgacggttgtctactcctccgacagacctgatgtggtctcagtggataaagacgggcgggttatggcgttgaggcctggcaccgcggtgattacggcaaaagccggcgaaggaaatgccgcctgcaccatcacggtaaaccacagaaacagctctgattccgatgatgacggggattggaccacagcagacggtccgggcgttgcggacaccgcccgcggaagctgggaaccggccagcggccagtggcgtttccagaaggaagatggaacctatgccgcgtcctcctgggaacggatcggaggcgtgtggtattacttcaaagaagatacctatgcggcctccggctggttccggttgggagattcctggtattacttaagccaggaggcggaaacctttggcggaatgcagaccggatggctgtatgatccgtcctatgaacgatggttctatctggaagagagcggaaccatggcggtgggatggaggcagatagacggaaaatggtattattttcatgcggtatccgacggtgaaatgggaaagatgtatgcaggagaacggactccggacggatatgtggtaggaacagatggtgagtggagccattgacagactgaatttcaacaataatgggccgccggcacagcctgcggcccgctgttttcaaacaaacaataaataaaccgccttgcttgcgcaagacggttaaactttttaggggggccggctaaggtgcgacccttagccggtatgagtatgaaaaagctttgtgattccaagtaatcacttgaaacaaaggccttgctcacctctcggtgaacatgttattatgataggtcagaaatgtgacaaaagtatgtctacacaatgaaaaaaacataaagaatataaaaaacaaaaaaaccctttgaaaactttgcgatattgtatataatagaagcaatgcaagaatggcagtagccgcgcaaccccttattttacaagcaaaaacgtaacagttcagacggctcatcttcttgaccgaaaaagacgggtcaagaagcatcggatgtccatccgatgtgaaaattggcgcggaaacccgcttacaagcgagcttgacgcggcttaccgcgccaattttctcgccgtctgaactgttacgcaaaaacggggtttccgacagaggcggcgtgacagatgggtacactgtgttccgggacaagccgcccgggatgcttacagcaaggaggaaataaattatatgttttcaatgatgtcaaatgatataggaattgacttgggaaccgccagcatcctggtgtacatcaagggtaagggcgttgtgttaaaagaaccttccgtggtcgccatcgaccgcgacagcaacaagattatcaccttcggagaggaggcccgcctgatgatcggccgtacgcctggcaacatcgtggctgtgcgtcccctgcgccagggcgtgatctccgattacaccatcaccgagaagatgcttaaatacttcatccgcaaggcggtgggcaagaagaccctgcgcaagcccagaatcagcgtatgtattcccagcggcgccaccgaggtggagaaaaaggccgttgaggacgccacctaccaggccggcgccagggaagtggccatcatcgaggagccggtggccgcagccatcggagccggaatcgacatcggcaaggcctgcggaaacatgatcgtggacatcggcggcggcacggccgacatcgcggttatctccttaggcggccccgtggtcagcacctccatcaaggtggcgggcgacgatttcgacgaggccctggtgcgctacatgcgtaaaaagcacaacctgctgatcggcgagagaaccgccgaggagatcaagatcaacgtgggcgcggcctaccgccgccccgaggttctcaccatggaggtgagaggccgtaacctggtaaccggcctgccaaaaaccattgtggtgacctccgacgagacgctggaggccctgagagagccggccatgcagatcgtggacgccgtgcacaacgtgctggagcgcaccccgccggagctggcggcggatatctttgaccgcggcatcgtgatgaccggcggcggctccctgctcagcggcctggacgccctgattgaggagaaaacaggaatcagcaccatgatcgcggaggatcccctgaccgcggtagccatcggcaccggcaagtttatcgaatttgcccacggaatgggtctggacggggaacgcgacgaatactgatccggggactgaaagcgcaatatggcaacgatcacaggatttattgagaaaatcaagttccggaacgaggaaaacggctacacggtcctgactgccacggaccagcatgacggcgacgaggtagtcatggtgggaaacttcgcctatgtgggcgagggcgacatgatccaggccacgggccgtttgacggaacaccccatatacggtgagcagctgcaggtggagagctacgagattaagactcccgaggacacgctgtccatggaacgatatctaggctccggtgccataaaaggcatcggggccgctttggctgcccggattgtccgccatttcaaggccgacaccttccggattatggaggaggagccggagcgcctctccgaggtcaagggcatcagcgagaagatggccatggccatcgccgagcaggtggaggagaaaaaggacatgcgccaggccatgatgttcctgcagaactacggcatttccctcaatcttgctgtaaaaatttaccaggagtacggccccaagctctacggcattctgaaggaaaatccttaccgcctggccgacgacattccgggcgtgggatttaagatggcggatgagatcgccgggaaggtgggcattttcaccgactccgactaccgggtgaaggcggggatgctctacaccctcctgcaggcggtgggaaacggccatacatacctgccgttaaacgagctgctaaaggaggcatgcgagctgctgaaggtagccccctccgccatggacaagcatctgatggatatgcagatggagaagcgcctggtggtgaagaataccccggaggggcagatcgtctactcttcccagtattattacctggagctgaacacggcccggatgctccacgacttaaacatccgcggcggcatcccggagacggagatcaagagccgcctgctgaaggtggagcagcaggaatccattcagctggacggacttcaggagcaggcggtgatggaggcggtgaacagcggtctgcttatcatcaccggcggccccggaacgggaaagaccaccaccatcaacaccattatccgctactttgagatggagggcatggaaatccttctggcggcccccaccggccgcgcggccaagcgtatgaccgaggctacgggctgcgaggccagaaccatccaccgcctgctggagctggtgcccgctcccgcagcctcggcccgggatatccccggggctcccggcggcaagggagggccgtccggaatggcggggatgcattttgagcgcaacgaggagaatccgctggacgcggacgttattatcatagacgagatgtccatggtggacatccacctcatgcatgccctgctgcgggctgtgaatgtgggaacccgcctgattctggtgggcgacgtggaccagctgcccagcgtgggacccggaaacgtgctgcgggacatgatcgattcccagtgcttcaatatggtcaagctcacccgcattttccggcaggcggcccagagcgacatcatcgtgaacgcccaccggatcaacgagggccagccggtggacctggccaagcgcagcaacgatttcctgttcatccgccgggagaacccggacgccatcataagcgccatggttaccctgatccagaagaagctgcccggctacgtcaaggcccagccctacgacatccaggtgatgacgcccatgcgcaagggggccctgggggtggagcggctgaaccagattctccagagcttcttaaatccgccggacaagaccaagacggagaaggaatccggcggaaccatctaccgggtaggcgacaaggtcatgcagatccggaacaattaccagatggagtgggaggttgtgaaccgctacggaattcccatcgagaccgggagcggaatcttcaacggcgacatgggcattatccgggagatcaacgactacgccgagcttctgaccgtggagtttgacgagggcaagcgggtggagtacagcttcaagcagctggaagagctggagctggcctacgccatcaccatccacaagtcccagggcagcgagtaccccgcggtgatcatccccatgcacagcggcccgcggatgctcatgacccggaacctgatctacaccgccgtcacccgcgcccgtacctgcgtctgcctggtgggcctgccggaggtatttgccgccatggccggcaacagcatggaacagaagcgctacacagggctgcggcagcggattgaagagctgtacgcattggaggaagaggagtagattccatatccggaggtgctgatgattttaaaatccctgacagactgcgcaatcgacgcactttttccacgccgctgcccggtctgcggccgcatcgtcgtgcccaggggatgtctgatctgccctggctgcataaaacgcctgtcctgggtgaagcagcctgtctgcaagtcctgcggcaaggaactgtccgtagacacggtagaatactgcttcgactgcgcacgccgtccccacagctttgtatacggccgcgccctgatcaattacaacgaagcggcttcccgctccatggctcagatcaagtacaacaaccggcgggaatacctggactactacgccggggagatggtccgccggcttggcccggcggtcaaggccatgggcgcccaggccctggtcccggtgcccgttcacccggagcgcatgaaaaccaggggcttcaaccaggcggaggagctggcccggcgtctgtctgacggtctggggctgccggtggaaaccggtattctgtcccgcaacaaaaacaccgcgccccagaaagacctaaaccccgcccagcgccttaaaaacctggaggaggcattttcggcaaaacgtccccgggcgggccttacatccgtgatcctggtggacgacatctacaccaccggcagcacggtggaggcgtgcagcagagttttgaagcgggccggcgtttccagggtgtatttcctttgtatctgcatcggaggcgggcgctgagccgcgcgcagttgtatgcggtatcatacagggaaccggcgaaagctgaatagggaggaagaaaaatgggaatatttgactatgaggtaatacagatcgacggcgattacgcccatctcaggaatctggaccgcccggaggacgggttaaagctggtggcaagagcgctgctgccccaggagatacaggaggggagccgcctgcattacgagtgctttgagtacacgctgacgggcagatagccgtggcgttcgggcgggcgtttttgtcccgcggcatgcgcgccggttttacgttgtatcatccctggaaatatgcgaaaatccaggtttttccagcaaagaaaccgctgaaaacccatccggcgaaatccggcgaaaacccgtaaaattcgcgcattatgcttgacagtatgcggttattgtggtaaactgtacgggcgaatggaagagcttaggtcttttttttatgctcaaaaataaggtcctgagcaaaatgtgaactacgataatataagtggaggtggaagtcgtgcgaacaaagatcacactggcatgtacagaatgcaaacaacgcaactacaacatgactaaggataagaaaactcatcctgaccgtatggagaccaagaagtattgcagattctgcaagacccatacgatgcacaaagaaacgaagtaatccggctcagtaaaggacgtgaacgttatgggagaaacagcagccaacactgcagtaaccacagagaaagcggccaaggctgaaaaacccgacaaggcgaaaaaagccaagaaggaacagaagcccagcttctttaaggggttgaaaactgagtacaagaaaatcgtctttgctgacagacagaccgttaccaagcagaccattgccgttgtcctgtcatctatttttctgggtgtggtgatcatgctcttagacatggtgattaaatttggtttgggatttatcttttaataaggcgagggtgaatgtatgtcagaagcacattggtatgtagtccatacctactcaggttatgagaacaaagtcaaggtcgacattgagaagacgattgagaacagaaaccttcaggaccagatcttagaagtttccgtgcccatgctcccggttgtggagctgaaaaacggcgtggagaaaaaagctgataagaaaatgttcccgggttacgtgctgatccacatggtcatgaacgacgacacgtggtacgtggtgcgcaacacccgcggtgtcacgggctttgtgggtccgggctccaagccggtccccctgaccgaggacgagatgaaaggtctcggcttccgacatgaggatgtcgtcgttgactttgaagttggagatacggtcgttgtaacaaacggtgcctggaaagataccgtcggcgccatcaaggcgattaacgacggcaagaaaaccgtcacgatcaacgtggaaatgttcggtcgtgagacaccggttgaacttggcttcgcggaagtcaagaaaatgtaacacaaggaatcagccgctgcaggcgcagcagctggtgggagggagattcccgacaataccacataattttaggaggtgcctaagatggcaaagaaagtaacaggttacatcaaattacagattcctgctggtaaggcaacaccagcaccgccagttggaccggctcttggtcagcatggtgttaatatcgtacagtttacgaaggaattcaacgctagaacagcagatcagggtgatatgatcatcccggttgttatcactgtatatgcggacagaagcttcagcttcattaccaaaactccgccggctgccgtactgctcaagaaggcttgcaatctgaagtccgcttccgcagttccgaacaagaccaaggtagccaccatcagcaaggcagaagtacagaagatcgcagaactgaagatgcccgacttaaatgccgcgagcgtcgaagctgcaatgagcatgatcgccggtactgccagaagcatgggaatcgttgtagaggactgactgtgagcgcttcgtgaggtatctcacgaacttagcgcgaacgtcgttcgcgaatcttagcgaggtcttatcgagcttagatgagtgaacatacccgattaaaacatgcaaattgatgggattaacatgaaaacgtgggagggagattccccgacaacaccactaggaggttatttagaatgaaatcaggtaaaagatatgcagaggcctttaagaatgtagaccgtactgctctttatgacaccgcagatgcgattgcattggttaagaagaatgcttctgccaaatttgacgagactgtagaagcccatatcagaacaggctgtgacggacgtcacgccgaccagcagatccgtggagccgttgttctgcctcacggcaccggcaaggtggttcgtattctggtattcgcaaagggaccgaaggccgacgaggctcaggccgcaggcgcagactatgtaggcgctgaggagctgatcccgaagatccagaacgagggctggctggactttgacgtagttgtggcaactccggacatgatgggcgttgtaggccgtctgggccgcgtgctgggccccaagggccttatgcccaaccccaaggccggaaccgtaaccatggacgttaccaaggccatcaacgacatcaaagccggtaagattgagtacagactcgacaagaccaacattatccatgtgccagtaggaaaagcttctttcgcagaagatcagttagccgacaacttccagacgcttattgaagcaatcatgaaagcgaagccgagcaccgttaagggcgcttaccttaagagcgttaccctgacctctaccatgggtcctggcgtaaagctgaacgtagcgaagctgaccaactaattcgtgtttgcgtatattaaaggtaacagttcaggacggcgggggaattggtacagaaagcagcgtcaagcttgcttgtaagctgttttttgcaccaatttccacatcggatgtcctgaacagttactattaaagatgatttttcatcttgacatccatcatatcgtatgatatgatacctgagtattgaatgcctaagacagcaggtgccgcaaggcgtaaggcgtaaccgcctgccgaggaacatacaaaaactcaagcttttttgtgatgagattttgcagacctctctgtctttgggacggagaggtcttttccatgctatgacggttttcaatgcgaaaattttataaggaggtaaaccattcatggcaaaagttgaattaaaacagccgattgtggacgagatcaaaggtgtgctcgacggcgctcagggagcggttgtcgtagattaccgcggccttacagttgagcaggatactcgtctgcgcaagcagctgagagaagccggggtgatctacaaggtatacaagaataccctgatcaagcgtgccgcagaagggacagcgttctccgctctgaatcccgatctggaaggcccgactgctctggccgtatccaaggaagacgccacagctcccgcaagagttctggccaatttcgccaagactgctcccaagctggagttaaaagcatgtgttgttgaaggcacatactacgacaccaagggaacgcaggtgatcgctaccatcccgtccagagaagaactgctgggcaagctgcttggaagcatccagtccccgattaccaactttgcccgcgttatcaatcagatcgcggagtccaagggcggcgctgccgaggcgtaagtttcggtcgctatattatcaaaacacaaattcgaattataataggaggaatataaaatggcaaagttaaccaccgcagagtttatcgaagctatcaaggaattatccgtattagaactgaacgatttagtaaaagcatgtgaggaagagttcggcgtatccgcagcagcaggcgttgtagttgcagcagcaggcggcgcagcagcagctgaggaagagaagaccgagttcgacgtagagctgaccgaggttggcccgaacaaggttaaggttatcaaggttgtacgtgaagctaccggcctgggcctgaaggaagccaaggaagtagttgattccgctccgaaggctgttaagtccggcgtttccaaggaagaggccgaagagctgaagaccaagttagaggccgaaggcgcaaaagttactttgaaataattccgcgtaacaatttagacggcgggaaaattggtgtggaaggccgcgtcaagctagcttgtaagcgaccatccacgccaattttcacatcggatgaatatccgatgcttcttgaccggttttatcggtcaagaagacaagccgtcggacggttgcgacgccctaaaggcggctgcagaagcatttccaagcttccgcagccgcctttttgcccttttctcaccacgtaacaatctcatcaattatcgcccgctgctcgttcgaggaccgcgtcaaataaatccgtgtagtctcaatgctgtcatgccccatcagatccgccagtagcgcaatatcgttaaatctggacaaaaaattctttgcgaaccgatgccggaacgagtgcgggtagacggtatccgggttgatccggtaacgcctggccagcacctttaactgcgagctgattccgcgtgcggtaaacggagcgccgtttcggttggtaaacacaaagccggtctgaagccctctcgtctccagccagtccagcgcgtcccggcacagcgcttccggaaaataaacccggcggacctttccgccctttgagtacagatccatataccccatgcggatgtgttccgccttgatctggagcagctcgctgatccgcgcgcccgtgctccccagaaaatggaccacaaaataccagaagacgttatgatcctccttaagcccccgtttaaggcgctcgtaatctcgctgggagatcacattgtccagaaagggcctgtgctgcaatttgacggcagccagctggtagccggccggtatttccgcgccgtcctgctccaggagcttcaggtattgattcattccgtaaatgcgtgaattggccgtggacggcttgtaatgggcgatcaggtaattccggtaatcattcagcgattccaggctcagattgccgtacagggactcgtagagccacagtgaacgggcgtaggtattaatcgtgtttgcggaggctccgcgctgtctgagccgttctttaaaatactccaggcgctgctctgcccccgcgttcagatcacagtattccatcgcatcactcctaccagtttacaacctgattgacaatccgagcctgttccgtgctgcttcgccgcagataaatccgtgtggtttccaggctttcatgtcccagaagatcagacagcagcgagatatcccctgagtgctcaataaaatttttggcaaaacggtggcggaaggagtgagggtacataacctcaggatccagattataccgtgcggcgaaatctttcagccgcgagcggactccggtgacggacagggcggaaccatagcggttcagaaagagagggcctgtggtgcggtgttcctgttcaagccagctcaggattgcgcattttaagcgggttggaacgtaaacccgccgcatcttatttcctttggaatagacgtccttgtgcccgagctttatgtcctcgacgcaaaacgtaaccagttcgctgacccgcacgccggtggccgcggtcagccacaccaggtagaagtagctgtattcctcatcctcccacagcctgcgtttcaagtattcatagtcggcttgggttataatcttgtccaaatatgttttttgctgtacctttaccatcgaaagcggacaaatgtctgctttgcagtattcaagataagagttgagcgcccggatccgcaggttgacggtttgaggtttatagtgctctatgagataaattttgtaaagctgcagattgcggtaggtcaggcgggggtagcagtgcagatactgttccaccgtaaaatggtaaatgtgaatggtgttgggggccaggttgtgggctgacagataggtgtcgaagcctcgtttgaccatggcagccgctggctggattgccggcatagtgcattacctccttccggttgtatttacgagccagtataacattataaaaccacgaaatgtcaatatggttcacaaaaaattcactatattgtcggaattctctcgcgcaaaccgggaaaatgccacattattgccgcgaaatttttacataaactttacagagactggttaaaacatgggccgccggctgcgccagcggcccattgcgctcaatcatggccggcaggttaatccggcggccattgcactcaataaagggccacaggctgcgccggtggcccttcgcgttgaagaaaaggccgctgtgctttttacggcacagcagccctggaaaatctgaggtctgcccggcgcagtatatcgccgggcagttttgtcgcaatttggaattttcttatgtcaatggatgattagtcttctaaaacaacctgagtgatctggtagttcttcacattgaacttgtagtcctcgccgtccttggcagcagatttattcttaaccatggagccggaggtatttaccagataaagcttaacgctggagtcaatatcgtcattcacattccaggtagtggcgtcctcgtcgtaatccttgtcgctctcctccagctcgtggcaatactcggtgaggaaatcatcggtatccatcttctccatggtcacgatgccgtcctcgtcctcgctgtaaataaccacctgatacttatcgtcgctgtcggcctcgatcagcttgccggcgctgtacagcttgtggtcgtcgattccgttgataccggcgcccttactgctgctgctgtccttgaacttgaaggtaaaggagtcgccgtcaatctcaaccgtctgtctgccggtcttcatggcgccgtcatccgagtcgccgaagtagaaggagcggatctcgccgctggaaatctggggagcgtagtgaaccacaaaatcgtcgaacgcatcctcggtatcgtaggggatatcgccgtcgtcagcaaacttctgagcaatttcggaggaatccactttaccgttctcagtcgccatctgcaggaataccagaccgtcaatcatacggccgtagttgtcgaatgcgtactttttgcccttgatggtcttgattacgttggagtaaatctcgccgtcgccgtctgcataataccagtaatcgtccccgtcgttgtatttgtcctcgtgcaggtaatagccgggaacaaccttgaaccaacccttggtggcgcgggcgccgtcctcaggagtgctgaaatacataaagctgctggtataggaggcaacaccctgagttgcggtgctgtaggaggcggtctccgtgaaccagtcggcgatcatacggccatactcgtcgaagccgtattttctgccgttgatggtcttggtctttaaggtgtcgccgtcatcggaatccgcagcgactttcttgccggaagtctggaaatagaaccagcggtcctgatcctcgtcccagtattcgtcgccaggctgcagatcctcgtattcatcgtccacgatggagatctgtctccagcctaagctcatagcgccgtcgtcctcatcgccaaagtagtaaaggctctctttccaggcatcgtcatcggtctggcgctcgccgccgcttacccacccgtacagcattctgccttcctcgtcaaaggcatactttttgccgttaatggtcttggcggaaacggagtcctcgctggcattgtcggatctggtgtaggccttgccgttggcctggaaatagtaccagtagtgatctggctcatcctcctcgccggcatcctcattttcaatggcaacccactgattggtgaccatcacaccgttggcgtcaacgtaatagtaatcgtcgtcatcctcaaccagcatatcaactgccatctcgccgttgtcgtccagccaataccagttatccccggatttcttccactcttcggtcactctgtcattgctgctgtcataataaacccaggttccgtcctcctcagcccaaccctgagccgcgaaggaagtcatggatgcgccgatggccagcagtgctgccgtagataagacggcaactaattttgtctgctttctcataataaatgcactctcctttttctttttaaaatactttttgaaattcctaattgcattacgagttgattatacttccgatacgggaaattatagacaccagcaatgtaaatgcttacaatttttctccgaaacctattgaatatttccggagaatgttgtatagtaatctcagcaaataaaaggaaagcgcagtgcacccaatagtgtaagcgcttacaactagtcactcacactatttcatatggaggtagcaaatcatgagcagtaacgtaaaagaaacagtcatccagtttggcgagggcggatttttacgcggttttgtggactatttcttccacaaacttcaggagaagggcctttacgacggcaagatcgtagtagtgcagcccatcgagaaaggtatgtgccagaccctggcggagcagaactgtgagtacaacctgttcctacgcggtattgacaatggtcaggttgtaaacgagcacacccatgtgacgtccatttcccgtgcactgaatccctacacccagtacgacgagtacattgccctggcatccaaccccgatctgcgggttctggtctccaacaccaccgaggcgggcatcgagtatgtaggcactgagaaactcaccgacatgccgcccaaggcatatcccgccaagctgtgccagttcctgtacaagcgctaccaggccggtttaaagggtctgatcctgcttccctgcgagctgatcgacgacaacggcgacaacttaaagaaatgcgtgctccagtacgccgatctgtgggagctggaggatggcttcaagaactggatcgagaccgaaaatgacttctgcagcaccctggtggaccgcatcgtaaccggttaccccagggatgaagtagaagagctgaccaggcagatcggctacgaagacaagctgatcgacaccgcagagatcttccacctgtgggtaatcggcggccatcacgaggacgagctgcccttccagaaggccggctacaacgtcgtatggaccgacgacgtgcatccttataagaagagaaaggtacgcattctgaacggaggccacacctccatggtactgggcgcccatctgtacggcctgaccactgtgggcgagtgcatgcaggacgagaccgtaagctccttcctgaaaaagtgcatctttgaggagatcatccccaccatcggcgacaccgaggacaaccgcaagttcggcgctgccgtgctggagcgtttctccaacccgtttatcaagcatcagctgttaagcatcgcgctgaactccgtgagcaaattccaggtccgcgtgctgcccaccattttggagtacaaagaaaaattcggcaaatacccggccggccttaccttctccatggccgccctcatttccttctaccgcaccaacaaagccaacgacggcgaggagatcatgaacttcatgaaggatgcatccgtcgaggagatcctgaagagagaagattactggcatgccgacttaagcgaaatgattcccatggtccaggaatactatgacctgatccaggccaagggaatggccgatgcctacaaggaagttctggccaaataggactttcgcctctcatcgcgaaggcgtaaataccagatcattccaggggaaacatgagtatatcgagtgagatagatccggaaagggcagcgcatttggcgctgccctttccgcaatacaagcacagactttgtcgtttgaatccccagctcagggggcgtcccgaaagctatcgtcaggttgcatggatggatatggaagattgtactaatatctgtacaatttgcgataaaaataacacttctgtaataattatgtaagaaaatgcacaggtaaatgttatggtattttaggccggactattatatactaaatgcgtgtgatggagttggtggtatgcctccaatataaattgtcatattttaagtattttagtagaaaatacaaaaaatgcaaaaaaactattgataatttcccttattggaagtataatcaactcgtaatgcaattaggaatttcaaaaagtatttcaaaaagaaaaaggagagtgcattaattatgagaaagcagacaaaattagttgctgtattatccacagcagcactgctcgccattggtgcatccatgacctcttttgcggctcagggttgggctgaggaagatgggacttgggtttattatgacaagaatggcgacaaggtaaatgaagcttggaagaaatctggagacaactggtactggttagatgataatggcgaaatggccgttgatactttggttgaggatgatgatgacacctattatgtagatgcaaatggtgttatggttcgtaaccagtgggtagccattgagaatgaagatgccggagaagatgacgagccggataattattggtactatttccagagcaatggtaaagcttataaaagatccgatagcgccagcagtgatgctattaatgcaaaagttatcaatggtaagaaatatgcttttgatacagatggaagaatgctgtatggttgggtaaaagatggcgaacgtcagacagatgatgacgcttggcaggatccggatgcatattactttggcgatgaaaacgatggcgctatgtctattggctggagactgatttccattactgatgataacgcagaaggtgctcagcctggtgatgaattctgggatgaagatcaggatcgttggttctggttcaagtcttccggtaagaagcagaccagcaaggctaataagaccattaatggcaagaaatatggctttgatgagtatggccgtatggtagcttcttggtatgccaaagatgtagttgccactactacagcagcttctacttctatgtctactactgatcaggttcagggcgtagcttcttattctgaggcatttatgtatttcagcgatcctgagagtggcgctcgttatacgaagggctggtttaaggtagttcctggttattacctgcatgaagcaaaatataatgacggtgatgagtactggtattatgctgatggtgatggcgagatctactcaaatgtgattaaaacaatcaaaggcaaaaagtatgcgtttgataactatggtcgtatgattagcggattagtattcctggagatggcagacaatgaaacttccagcgacatcgctatgaagtatgctgatgatgctggtacttatgacaaggctggttatcaggataatggcaagacaggtccttatgatacagaagataacttcgatgattttgtaaaagatcatcaggatgaaattgccagcggtaaggtgagaagctactattttggtggttctgatgatggtgctatgaagaccggaaaacagaatgtaaccattgatggagatagctttagcttcaaattcaagaccggttctaatctgaagggcgctggtattaatggctttgacgatgataagctttataccgcaggtaagcagattaaggctgacaaggatgataagtacaaagtttacaaagtgacaactaaggcagacagcaattactgtaaggttgaagatatgactgtatctgaattccttaaggttcaggatggtattgataaggtagaaaagagctacagttctacaaaagaggaaaccacttggaagatcacttatacagactatgctaccgatgcacctgaggttgtaaagttctatttgcttaatacttccggaacagtagtaaagagcaagagcggtgctaaggatgctgatgattataagttctatgtaagcggcaagacaattaacgaagttgtgcttgaagactaatatgtaattattggttagaaattctaattgctataattaaagagtatgccagacagcgtattggctgtctggtttctctggctctttgtcaatagttggggtgggatttgttaaaatcccgccccagttctatgataagggcacttttcatgtatggttctagcttttactgattttggacatgccaaataagcctccgcattaccgaccattttatcttatgatgtacagtggagtatccgggtccggaaacgcttgaagttccggattccgtagctgctccgttttaatacctttattttgttgttgaagccttctgtgggaccatttgtcagcccatatttaaaggcatttaggatttctttgcgccaggccctgtaagtcttggcacagtcctcaaattccttgatcccacagctctgcgcatttgcaatccagtcatcgaattcccgctgttgctggcggtatgcttccatctggcagatatcatagaaccactctttcatgcggtgtgccagacgcagatcctcgctatagtgaagcattaaatcacaggcctgtttgttctcatccttcagctttttatagcgggtcagaatgagtttccggctgcgtttataatacttacgcagggaaaccggcatggatcgctgcagccgtttgcgtacgttttcaatcgcccatgtcacctgccggatgaaatgatatttatccacgatgattgtagcgtttggaaagaaggtctgtgcaagttcggtgtaggggcgccacatatcgcagacgaagaactttaccttcaggcgttctttcctgggaatgttccgccaataatcagccagatggctctgggtccgatccgggagaatgtcgaggatccggcgctttttcggatcaaccagaatgcactgatatttactggtagaagcattgcctttgaattcgtcaatagaaagagcttgcggaagctggccaggcggaggatagcaaatcgtgtccagaaggcggcagaccgtctggacggaaacaccggtaagttctgcgatctgttttaaggaaaaggtctggcggagcagggagacaatgtaaaatgccagcctgcgggtcctgcggtggtagctggggaggaacgaatagggctccgtgaaccgtttgcggcagtatgggcagaggtagcggcgtttgcgaaggagcaggatgacatgttttcccagtaagggaatgtcctggacctcttgtaaacggtaatcatgaatccgttttgttttagccccacagcaggggcaagtctgttctgccggttgggactggatgaaaattttaatgaaagagtctgcctgaaccacttttttgataaaaacaccttccaagtcaaggaaagccttggtataattagggtacatctataaggggtcacctccgaaacattaaactttggtcgggataatgcgtttgggaggcttcttatagatgtattttattacaacgaaaagaatgttggaattgtgcttttcagcacaccccaacattcagtatagaaccgtttctcttttgttactactgttaaactacctaaactgatcaggaggctacataaccgtaccgctaactcgctaggacagtatagttataatcggactttgtcaccttcttccttgatttcataatcagaatatccttgtgttggttgtaaatgttcttatgtattataatgcattctcaaaattgtttatatgaccattttgaaaacatcgtggagtacattcctgccaaaaccagctcatcacaataatgaactggctagtgtcattgcatgaaaacaaatttaattatgagtaattttattccgatgaaaatgatgttgagtgctctcgttctctcgaatcaccattttttattttatagttcacaaaatgctactgtctaaatgtacacaagacattacaagcgttttgcatgcttagtcaggtaaacttaatcatctaaaaattagacggctgcatattcgttatacaacgctacgatagcagccgccatactttatattaccatgtaacaatcttatcaataaattttcgctgttccagcgatgatttagttagatatatcctcgtagtctcaatactctcatgccccatcaaatcggccagaagtgaaatgtcattaaatttgttcaaaaaatttttcgcaaatcgatggcgaaaggaatgagggtatactgtttctggtggaatgtggtaacgaactgccaaaactttcagttggctgctgattcctctaggagtaatctgatcgccttttttatttacaaaaataaaaccactgtcacggccttccctagccaaccaagagagcatttctaaacataatttttcgggaaaataaattcttcttagctttccacccttcgaatacaaatccatgcagccaatacgaacgtgctctactttaatttttaccaattcgctgattctcgctcctgtggcagccagaaatcgtaccacaaaataccagaacatgtttccatcacgttttaggcaccgtttaaggcgttcataatccctttttgaaatgacgttatccaaaaaaggcttctgttggcgtttaacggaaggcagcctgtaactttccagcttcatttcgggattgccgcccagtgtttcaatgtattgattaataccgaatattcgtatattaacagtatttgctttaaaatgctccaaaaggtactctttgtatgattgaagattgggaatattcatatcagaatacagtgaataataaagtcgcacagaagctgtatatgcgctaattgtattgggagctgccccgcgtttctttaagtactccttaaacgtctcaatttcttcttgctgaaattcggtcatcgttttttctccttaccagtcaacaattttatttacaattcggtactgttcgctgctgcttcttctaaggtaaattctagtagtttctatgctttcgtgtcccagaagatctgacaacagtgcgatgtctccactattttctataaaatttttggcgaatctatggcggaatgaatggggataaaccacttctgggtcaagattataacgcagcgcaaatgtttttaactgccctcggattcccgaagctgtaattgggtttccgaaacggttcagaaataaagctcctttatttcttttacttttttccagccatacctcagttttttgtttaagaacagtaggaatataaatacgcctcattttatttcccttggagtaaatatctttaaatccaaactttacatctgcaatttcgaattttacaagttcacttattctgacaccggtggccgccatataacgaatgacgaaatagtatgaaaactcctcgtcttcccatagccggcgctttagatattcataatccgcctgactgataatgcggtccaagtacattttttgctgtattttaatcatggtcattttggagtctttatggtttaaatactccatataacaattaagagcccgtattcgcagattgaccgtctgtggcttgtaatgctccaataggtaaactttgtagagctgtaatgtagcaatcgtaagctctttatgaatctcaaaaaattgcctaactgcatagcaatatacacaggtagtatttgttgacatgttcttacttgtcaaataatcccggaacctttcttgatataaatcggtacctctactatcaagcgaatccgcctcctttaaaactgccattataatcgcctccttttgatcaacatcatatagtatattaacctatatattcgcaaaaagtaatatgttttgattaaattttagaccaaataggagaatatctttcataaaatatccaaaacagggaaaatataaagaacttgctaaaactatagtgtttgccatgcctattataaatcgaaaacgtaattataacgcaatcttttatttttaaaataattcgaataacaaaagaattgctatataggcgatagtaactacttctctatagcaactgctaaatcaacaaaaactgagtaaatattgaaataatatagattaaaggtgaggtgattaattgaaaaatataataatgcgtgaaatttactttgttatatttttgtcagattacaaaggttgtattaggggactaattaatactttaagttgaagaagttctaattgcgaaatgagcagctgccgcacttaatgattgaacatcataggtgcggcagcgcttttgatttaagctttgtcactagttgggttgacaaagaaacagacttatgacagaaaggagttgccactccgtggatgatattattacatccactttgtagcaactcctaactacatacttaagctttggtttagcaattagtatttcatagaactatcagatcttttaaattagcctgcaaatgaaaagtcaatagagaatagaggatatttgcaaaaaagttttatgcagcgtttaagtactacaaaaagaccaccgtaaaacgctggcctattggatattgagtcaaggttattctggtttgggtaaggcagctaaatactccttcacacggccatagtagattcgcaggaacttattggcaccggcagtcatgtagacatagtacggcttcccttctgaacgtttcttgtccagaaagcgataaacagcgtcttgcgcagctgcggtgatcctcgcttggatgtacggacactacgtgcctcataggtgccggattgattgactccagggtccacaccggcaaatgcagttaatgcttcacgatgggaaaagcgagagagatcgcatatttcggccataagttgagggccgagtgaggggcctacccccttcatggccatgactacctgatactctggcagttgggcggcaagacggttcatttccaggcggagctgttccactgtgaaagataccgtattgagctgctccacagcctgcttaaccaaaaacttagtcacagggtctttcgtgaacacggaaatcagttctttggaaaacgaataaatctgtgctggtttttctggttggaagttatagccgtgccgtttgcaccatttttgatagcgctcagtaaacgcagcaagcccaagagagcgcacacagtccacgtgccagaatgaggaaacaaagtctacccatttctggctgccatcgctgcgggcagggctgtcaaagaagtcattaatgccagggtaagtctgatccagcagggagatgaggttattcttgtaagaggttttctatttcatgtagaagctgaactggtgattcatgatttttaattgattgcgaatgatatccatactggtatactggcgcaaatcctgccagttgtcaagagcatagcgcgcaatcttaacggaatcagctttatctgttttaactttacggagagtgttattgccgtaatccttaatcagcttaggattaaccgtactgacaaagaacccagagtcagagagccatcgggccataggttcataataccgccctgtatgctccatgataatccgtgtactgccgtccaaagaactgagctgatcaactagctgatggaaaccactggaggtatgcggaacttcaaatggtttggcaacaatttcgccgaacgggcggagggcagcaaccatacttttacctttagaaacatcaatgccaactgcgttcatagatccaactccttatttagatttgtaatgggaacccaacctttactcattgccgattctatctactgtggtgtgacacggacgtactggtaaccagcagttcaacctgcataaaacgaacggctgcgaatgagaggctggcagacagactaatttacggacgaaatgtccagcatttccgtcgtcagcccattgcactctctattctaacagctttagcaacaagagggatatagacacgactggctgtcgtgtactttacccataaatacattgtagtagtcttccgaggtaatggactcaataataccctctttatttactttgatcttatagtcatcgccattctttacagacttattaccatccacaatcttaccagaggtattgataactctgtaattagaaagatctacattcttaagatcctaaactgtagaatcttttacgcgatcaccagatacgttagaaataatatccccaaccttgaccccatcgttgataacaacatttacatctaagttatcggtattcttaaaggaggcaatctcaacgatctgatacttatcttctttatcagcctttatcagtttaccacctacataatacttatcatcatcttctccggtgataccagcacctttgatattgctcttggtctcgaatttgaaagagaagctctcgccatcaagatcaatagtctgtctgccagtcttcatagaaccatcatcggctccgccaaaatacataaaccgataggatccgtcagcaagctcttttgcaatcttattcattgcagtctcgttgaaattatcttctgtatcatacggattgtcatcatcatccgcaatcttagcgataatctgtccatcaccgtcagagattgtcgaatactgaatcagtgccaagccgctgatcatacggccatagttatcgaatgcataggtcttgcctttgatcttcttaacgcgatcggcaataatgtttccatcaccatttgcatagtaccaataattcgcatcatcttcatacttggactcatggagataatagccaggtactaccttgccccccctgtgcaacgagcaccatcttcgggactgctgaagtacatgaaggagttactatagcttgcaacaccctgagtagcattagcaacagatgcctcagtgtaccaggaagctaccatacgtccatactggtcaaagccatactttttgccattgatcttcttgtctacataagtcttgccctcatcggcagcctttttcttgccagaagcctggaagtagaaccatctctcctgatcctcatcccagaaatcatcgccaggctgcagattctcggtatcatcactatctgtaatagcgatcaactcccaagtattaactctcatagcgccatcatcttctccgtcgaagtaataatcgccatcctgccactcggtatcttcgtcagtctgtctctcgaatgtatcggcatctacccagccatacagcatcttaccatcggtatcaaacgcatactttttaccgttgataattttagcagagatggtagtagcactatcacctctcctgaatgccttgccattggcctggaaatagtaccagtaatgatccggctcgccatcttcgccagcatcctcgttctcgatagctacccactgattggttaccattgcgccattagcataatagtaatcatcatcatcttcaatcaacatatcaacagccatctcgccgctgtcatctaaccaataccatttatccccagacttcttccaggaatcagttgccttgtcgccatccttgttgtaataaacccaagtcccatcttcctcggcccaaccctgagccgcaaaagaggtcatggatgcaccaacggcgagcagtgctgctgtggataatacagcaactaattttgtctgctttctcataattaatgcactctcctttttctttttgaaatactttttgaaattcctaattgcattacgagttgattatacttccaataaagggaaattattgaaagctggagaaatgcaaaataaaagcaaaatcagatataaaaatatcgcgccgtacatagccatacagcgcgatctatactaacaatataatataacatttttgtgctcttgcgcatagtcaaccaaatcctgcgtaaagccgctaatgctaaaaaggatataatactcagtccgtttattacgattccattcaactgctgaagattttaggcgcaatttttctaatatatccaggccaatgggagacctccaatacttgcactctccgaaaataatattgtttccatccgagtcaagcgcgactatatcaatttcattttgaccatcccaccatcttccagctcgctcaaaatgaaaatcccaagccccatctccgtttaatttccaaagaatttccaaacaaatatcttcatacacatagctaacatggttatcgataaaattactctgaattttcttcatagcaatttcgctatgtccggactcaatcaggctaagatttggataaataaacttgaaccaaaacaaaagaaaattatcctttatcctgtatagcccccgtttgcttttttctggggattcttccgttattggcacttcacgctcgagaatatccaaatcaattaatgtttttaaatatttagtcaaacccgtctgtttcatttccaaaacgccggcaatcttgcctaatttttgatttcccgccgcaatcgtcttgatcagcgaataatagctcccaacctcattaacttccctctgtaataaaaaattgggttcgtcgtacaaaaagctggacttctgtaaaacattttttgaaatagcttggtaaatatcattttcgctatgaaacagctctatatatttgggaacaccgcctgtcactgcgtaatactcaatcaactcccgaagccctttgtctggaaaaaacttattgtagtatgagaatggtatttgcttcaatttgatttggccggttctacggccatacaaaggactggaatatgatagggtctgactttccatcatcgatataagggaaccacagagaatcaccatcacgtttcgatctttcaaaatagtatcccatattttttgaaagatcgaaggaaatgcaggattcgatttacccaaatactgaaattcatcaataagaataattaatcgcttatcagtgaccgaatcggttagcgtttggaatattaggtcccaatggtcaactgctgccgccttcaacaaggcgtttcctgtaaaatatgcaaccatatctttgaaagcattgcgattctgatgttcgctttcctctgttaccaaaaaatatatagcatgtttattttggatgaaatgtgtcataagcgcagtctttccaacacgacgccgaccgtatagaacaatcagagaggcacttgacgctgaatactgatcttccaaaaattgtaattcattttcacgatctataaagtttttcattttatcacctcgattatattataattcaaaatattataattgtaaatataataatggtattttctcaatttctattatacatacattttttcgtttttatgtagctttcaataatttccctttattggaagtataatcaactcgtaatgcaattaggaatttcaaaaagtatttcaaaaagaaaaaggagagtgcattaattatgagaaagcagacaaaattagttgctgtattatccacagcagcactgctcgccgttggtgcatccatgacctcttttgcggctcagggttgggccgaggaagatgggacttgggtttattacaacaaggatggcgacaaggcaactgattcctggaagaagtctggggataaatggtattggttagatgacagcggcgagatggctgttgatatgttgattgaagatgatgatgattactattatgctaatggcgcaatggtaaccaatcagtgggtagctatcgagaacgaggatgctggcgaagatggcgagccggatcattactggtactatttccaggccaatggcaaggcattcaggagaggtgatagtgctactaccatctctgctaaaattatcaacggtaaaaagtatgcgtttgataccgatggtaagatgctgtatggctgggtagatgccgatacattcgagagacagactgacgaagataccgagtggcaggatggcgattattacttcgacggagaagatgatggcgctatgagagttaatacttgggagttgatcgctattacagatagtgatgataccgagaatctgcagcctggcgatgatttctgggatgaggatcaggagagatggttctacttccaggcttctggcaagaaaaaggctgccgatgagggcaagacttatgtagacaagaagatcaatggcaaaaagtatggctttgaccagtatggacgtatggtagcttcctggtacactgaggcatctgttgctaatgctactcagggtgttgcaagctatagtaactccttcatgtacttcagcagtcccgaagatggtgctcgttgcacagggggggcaaggtagtacctggctattatctccatgagtccaagtatgaagatgatgcgaattattggtactatgcaaatggtgatggaaacattattgccgatcgcgttaagaagatcaaaggcaagacctatgcattcgataactatggccgtatgatcagcggcttggcactgattcagtattcgacaatctctgacggtgatggacagattatcgctaagattgcggatgatgatgacaatccgtatgatacagaagataatttcaacgagactgcaatgaataagattgcaaaagagcttgctgacggatcctatcggtttatgtattttggcggagccgatgatggttctatgaagactggcagacagactattgatcttgatggcgagagcttctctttcaaattcgagaccaagagcaatatcaaaggtgctggtatcaccggagaagatgatgataagtattatgtaggtggtaaactgataaaggctgataaagaagataagtatcagatcgttgagattgcctcctttaagaataccgataacttagatgtaaatgttgttatcaacgatggggtcaaggttggggatattatttctaacgtatctggtgatcgcgtaaaagattctacagtttaggatcttaagaatgtagatctttctaattacagagttatcaatacctctggtaagattgtggatggtaataagtctgtaaagaatggcgatgactataagatcaaagtaaataaagagggtattattgagtccattacctcggaagactactacaatgtatttatgggtaaagtacacgacagccagtcgtgtctatatccctcttgttgctaaagctgttagaatagagagtgcaatgggctgacgacggaaatgctggacatttcgtccgtaaattagtctgtctgccagcctctcattcgcagccgttcgttttatgcaggttgaactgctggttaccagtacgtccgtgtcacaccacagtagatagaatcggcaatgagtaaaggttgggttcccattacaaatctaaataaggagttggatctatgaacgcagttggcattgatgtttctaaaggtaaaagtatggttgctgccctccgcccgttcggcgaaattgttgccaaaccatttgaagttccgcatacctccagtggtttccatcagctagttgatcagctcagttctttggacggcagtacacggattatcatggagcatacagggcggtattatgaacctatggcccgatggctctctgactctgggttctttgtcagtacggttaatcctaagctgattaaggattacggcaataacactctccgtaaagttaaaacagataaagctgattccgttaagattgcgcgctatgctcttgacaactggcaggatttgcgccagtataccagtatggatatcattcgcaatcaattaaaaatcatgaatcaccagttcagcttctacatgaaatagaaaacctcttacaagaataacctcatctccctgctggatcagacttaccctggcattaatgacttctttgacagccctgcccgcagcgatggcagccagaaatgggtagactttgtttcctcattctggcacgtggactgtgtgcgctctcttgggcttgctgcgtttactgagcgctatcaaaaatggtgcaaacggcacggctataacttccaaccagaaaaaccagcacagatttattcgttttccaaagaactgatttccgtgttcacgaaagaccctgtgactaagtttttggttaagcaggctgtggagcagctcaatacggtatctttcacagtggaacagctccgcctggaaatgaaccgtcttgccgcccaactgccagagtatcaggtagtcatggccatgaagggggtaggcccctcactcggccctcaacttatggccgaaatatgcgatctctctcgcttttcccatcgtgaagcattaactgcatttgccggtgtggaccctggagtcaatcaatccggcacctatgaggcacgtagtgtccgtacatccaagcgaggatcaccgcagctgcgcaagacgctgtttatcgctttctggacaagaaacgttcagaagggaagccgtactatgtctacatgactgccggtgccaataagttcctgcgaatctactatggccgtgtgaaggagtatttagctgccttacccaaaccagaataaccttgactcaatatccaataggccagcgttttacggtggtctttttgtagtacttaaacgctgcataaaacttttttgcaaatatcctctattctctattgacttttcatttgcaggctaattgctagagatatcgagggtgtcgtaaaatcatcaaacatagatgattcagcggcaacctcgctctgcataaaaaatcagtagaaaatcatcatttgggaccagtccttttaaacttaatggtaaaaccagttgataagtgcaatattgattttttagtagtataattatttattcgcatacttaattataccacggaatggcggactcttcgaagtccgcttttccgttttgggggcgcagaaaaggaaataatgctctactagatcatttatccatttttgcaacagttcggtattttttatagattcataataattacttgtagactaaataatccaatcccatttgattaacaaggataactcgttaatcattaagaatatattctaaactaaaatattaacatcatggcatttttagtaaaagggcagaagtagtattcccatctggttaatcttttttaaatcaaaagcactgccgcacctatgatgttcaatcattaagtgcggcagctgctcatttcgcaattagaacttcttcaacttaaagtattaattagtcctctaatacaacctttgtaatctgacgcttgctaacgctaaacttgtaatcatcagcatccttagcattagtcttattcttcagaatagtaccggaggtattaaccagataatacttaacgctgtccgtattagttgtagtaacagtgtatacggtttcttccttatcatcatcatgcttaccaccatcggtgcatgtagcaataaagtcggtcgtggtcatctcggttacagagttattggtcttatcatacttataaacagtgtacttatcgtccttatcggccttaacctgtttaccagccatgtacagcttatcatcatcttcgccaactaagccggaacccttcaggttgctaccggtcttaaacttaaaggtgaaggactcgccatcgatcgttacagtctgcttgccagtcttcatagcgccatcatcagatccaccaaagtagtagcttctgatagtatgatcgttgatttccgtagcaaagtcttttacaaactgatcaaagttatcctcggtatcatacggatgaaggtcatcatcatcagctaacttattctggatctcgttgctggtagtaccattagccatctccaagaataccagtccgctgatcattctgccatagttatcaaacgcatatttcttgcccttgatggtcttgatttcattagagtaaatctggccatcgccatcggcgtagtaccaatactcgcttccatcttcgtacttagacttctgcaggtaataaccaggaactaccttaaaccatcccttagtataacgagctccgtcctcgggattgttgaaatacataaatgtattactgtaagtagcagtaccctgagaagctacagcagcagtagcctctgtataccaggaagctaccatacggccaaactcatcaaagccatactttttaccattaatggttttgtcggtgtagctctcgccgtctttagctgcttttttcttaccagaagcctggaagaagaaccaacgatcctgatcttcatcccagaactcatcaccaggctgtgcatcctcagcttcgtcatcagtaatagaaatcagtctccagccttcggacatagcgccgtcatcttcatcgccaaagtagtactggcaggtcttccaagcatcatcatcagtctgacgctcaccagcatctacccaaccatacagcattctgccatctgtatcaaaagcatactttttgccattgatggttttagcggaaatagatgtatcagaagcgctgtcagatctcttgtaagctttaccattagcctggaaatagtaccaatagtgatcaggctcatcatcctcaccagcgtcttcgttctcaatcgctacccactgattggaaaccatggcgccgttctcgtttacataataatagttgtcgtcatcctcaaccagggtgtcaacagccatctcgccgttgtcatctaaccaataccagttgtccccagatttcttccaggactcggtaaccttgtcgccattcttgtcataataaacccaagtcccatcttcctcagcccaaccctgagccgcaaaagaggtcatggatgcaccaatggcgagcagtgctgctgtggataatacagcaactaattttgtctgctttctcataattaatgcactctcctttttctttttgaaatactttttgaaattcctaattgcattacgagttgattatacttccaataagggaaattattagcagttttagtttggagggataaaagaaaggggagtgtattaaattaataaagcattaaaagaaatcggtcttttttgtaaaaatataaagttgtcgaaccggattcgtaatgatatactgtataaagggatttatccggtatattaaaacatatgtaagggagaaacactgcgatggaaattatgcatgataattatgatcatacatcatctcaaccaatattggaagagactcctgattttattcgaaacggtaagagaataatttcttttttattagcactttatttggttgcaatattatttgtatttcctatttactatagaaatttttattttgatatcctgggtgcgaaataccaattttattatatcagcactttaacgttgataggtggggttgtattaactggcatttttatgttaatcatagatctggtgcagtatgaagggaaatttacaacggggtttttgcaaaagttcagtacaaaaaatatacgaactacgttatctgtgcccgatgtttcattaatttgttttttggctattgctgtgttatcaacggttttttcggattatatttacgaatcattttggggaaatgaaggtcgttataccggtctttttttactgttgttatatggtggttcattttttattgtcagtaaatttttacattttcgatcttggtatctggatgtttttttagtatcatctgttctggtatgcgcatttggaattacagactatttcaatctggatattttacattttaaggagaatattgatccaaaacaatacaatatattcatgtcttttatgggaaatattaacacgtatacagcttacctcagtttagtgcttggcgtatcgagtgtactgtttgcagcagagaaaaagaatgggaagtgtgtttggtattatatatgccttgttatgggttttttggcaattattaccggacagagtgataatgcatatttggctttactggcattgtttgcctccctgcctttttatatgttccgaagttggggtggaatcaagcgatatctaataattttagccagttttttttcagtggtgcaggcagttgatattattaatcagacaatgtcggatcaggtattggaaatacaggggatatttaattttatcgtgaattttcaaggtttagcgtatattgttattggcttatggatagcggttgccgcattttatgcacgaaaatatattataaagcggcaggaaacgccggttggaaaaatgccctgtagaatatggggaattgtatttttgacagggatagtaatcgttttatggatattgttcgatgcaaatatagcaggtaatggtgagcgttatggcgcattaagtaattatgtagtgatcgatgatgaatgggggactcacagaggctatatctggaaattagcgatgagaaactataaagaattctccacagtccataagatatttggctcagggccggatacgttcggcatcatcaccgttaaaaacaattataatgaaatgactagtcgttatcacgagatttttgatagcgcgcataatgagtatttacagtattttgttacgattggcccgtttggactactggcataccttgccttactgatttcatcgggagtcagaatgataaggcacgcggcggataatccatacatgatggctacactgtttgcagtattatgttatggagcgcaggcattggtgaatattaatttaccaattgcgacgcctgtgatgtggaccattttgatgattggattggctggttgcagaaggatggaataagacagggaaatacggaacttctaactgtggtatcaacacatgatgtaaaaggcgtgaagttattttatggtgtccatgtaatgattaatggttggtattcgggttgttcataaaatatcgtagaacatacgtcctgtccatttatagctggggcataacttgctgatcccccggacgtttttcgggaattgatttgtctgtttgccccccgatccgttggctttataggttgggtggtgttttttggaggtggttgtgtaggttagttgggggtgggggtaatgttgcccgctataggggaagtagacgctccgaccagaaaatgtaccctcgccttctgacttatgaactgcatagggtcatcatagcatatgttcaactaacggatggcgttatctttgtccatattgtgtatgacctggttctggaaggtattcttcggcgctagccagtacattttattctccaccaacagcactatttgtatcgttcaaactgaaaacagcggcagaatcgctaaagtagattcctgccgctgtttcttcgcgtcagtgtatctgccaatgattggttgttgaccatcacaagtatggtctctgggttcatgtggtggtgctgctcctgcgggattcctataattaggacgtttattatcaggttgcctatcttatgtatgatttttgacaggcatgatagtgataaactagaactgcccgctatatttggagacgacgaactgagaaagatgctggaactgaagacgctatgattggtggtatatccttcactttgaaaaaacattagatgtctgtaggaccgttcacttgtgaaccaaagaatgcgaaaatctataatctattgtagtcggatttctgtaaagcctatgggtatccggctgcagaggtacagatggaagggcgagaaaggttatacggtattttgtaaagggaaaacagtctaggtatacaggacattacaatgctagaggtttcagtgcctacagggatttggggtataacggagtatccctatcgggaggcggtgagtcaaacagcaaagagattgcaaaaaaatatatcattatgaagctttacgagtagcaagaagctagctataatacaaaaccaactgtgtggaatgaagaattgtgagcttggctggttgtgattgtacacgattatttggggaaagatgaacgcgtcggaagtgaaaaagaacccctcaaaccatgtaacaaaaatatcagtctggaggagactgtggagcgttaccaggaatgctgatggactcaatataaacggaaaacgtttgcaccgtaagctccgctagatacggctggccatctgattgtgacgaggtagcagagggcaaacgacggcaacaaggaagattgtgatgtgtttttttgtggtttttttggttgtgggtggggggggggcaaaatcggcgttgcggatgatggtaatggactaagcaagatcataatccagcttgacgtaatgaagtttatagtaatcacattatctatatttgtatcaaatctattcctgattcggaggcgaatatttttaccttctagtattttcgagagttatgcattttgggtggctgtgtgttcgtatatgagccctgaccagtacatactaatgaaagaaatataaagcgaaaaagttttcctcttttagctatagcatgaaatttaaattaataatgtcaatttttaataaaaccttaaaggatttccagttgttttcgccgtaacataagttgcatattccagtttgaaatgctatactatacaaaggtttatcgtaccttttgaggaagtatggtgtatagggtcggagagtataatgaatagaagatattcggtattgatgtcggtttattataaggagtgtccggcgtatctacaggcagcaattgagagtatgttgaaccaaacagaagcgccagatgagatagttctagtttgtgacgggccattaactgatgagcagaatctagtaataggtgaatacttggattgcttgaaagtgttgcgcttagaatgtaacaaaggacttggaactgcactagcagagggtattaagttttgtagaaatgaatggattgctcgaatggatagtgatgatatttcggctgataatcgttgctctcttcaaatggattattttgagaagcatccagaaatagatgtgttaagtggtacgatagcagaatttgagggagaagcttgtacagaagaagaggttttgggaaaggttacatcttataagttccttccagaatctaacggtgagttaaaagaatatatatactgccgtaatccgatcaatcacccatgtgttatgttccgaaaatcaagtgttttagaagcagggggatatcaagcgtgccagttttttgaggactatgatttgtggatgaggatgttcaaaagaggtgcagtatttgctaatgttcctaatgttcttttatatatgagaattaatcatatgtatgagcgacgtggaggattaaagtatgcaaaggcaattataatgttttacaaaaagatgtacacaaataaactcattaccatgtcccagtttttgacggcagtgggaattcgggtaataataagtctaataccggctaaagctagacagtatttgtacgagaccgggttaaggaaacattagaatatgggtgaaaaaaagaacaacgctagattcgaaccatataagcgaattgtaaagtttttaagttccgctattattgttcttgcagagctaatcatctactattatgtgtggatgaactattataacataaatatgaccgtttccttttggagaagaggaaactggttaattgtaggtgaatatctggtgctgttgttaattttgcatcggatgtatggtggtttgaagataggtgtttttaaatattggaatctggtctattcccatatgatatctattttgggtgttaatgtattttcctatgttcaggttgtcctatttgataagaagatacataatcctatggcccttatactaatgacagtattagagtttttgggggtgatgttgtgggcgtttggatttaaaaagttttatgcaatattattccccccaaaaaagttattgttagtttatggaaagaagtctatgtttcacttgatgaatcgaattgacacgagagaagataaatatgaaatagctatggtactaccgattgatgagggaatagagcgaattatcaaacgggcggaagaatatgatgggattattattggagatataccagcgagagccagaaatcagctgttgaagctgtgttatgcaaataatattcgtagttatacagtgcctaaaattagtgatattcttcttcgcagctctatagaactaaatatatttgattcgccgctatatctgtcaaggaattatggtggcttagcatgggaccagcgagtgattaaacgcattgtagacattgtaatagcaacatttatgctggtgatatcaggcccatttttcgcagttattgcacttgcgattaaatgtacagaccaaggtccggtgttttatacgcaaaatagattaactaaaggcgggaagatatttcgaatttacaaattccgaacaatggtggtagatgcggaaaaaaagagtggaccgataaaggcaggagaaagggacccaagaattttgccggttggaaggttgcttcgggcaacgcgcatggatgaattaccgcagttgctaaatatcttaaaaggtgagatgagtattgtggggccaaggccggaaagaccggaattagctaatgttattacaaaaaatataccggaatttgattttcgcttaaaagtaaaggctgggttaacaggctatgctcaaatttatgggcgctactgtacaactagctatgataaattgaaactggatttgacctatattcgcaattactctatttggatggatattaaacttatttttatgactcccaaagtgttgttaatgaaagagtctacagatggtttcgaagagggagaatgggaagatccagcactaaaagaatagaatggaatggctatggaaaaaatattaactattgtagtaccaacatacaatgctgagaagtatttaagagataatctagcatcattctgtattccaagactgttaccatatttagaggttttggttattaatgatggttctacggatcgttcatcagatatagcagaagaatatgtgaaacgctatccatacacctataaactaattacaaaagagaatggtgggcatggctctggaattaatacaggtatattgaatgcaacgggaaagtattttaagatagtagatgcagatgactgggtcgaagaagaaccttttgtgaggctggttgagactctgagaaaaagcgattcagatatcgtggcttcggggttctactgggtgtatgatgaagggcaggcggataaggcggaattcgctcgaaaaccggagatgaaagtcccgtttttaggagtcgactatcaaaaaaaatatgtattcgatgaaatcgcagatcagctatatattaaaatgcatcatatgacaattaaaactgcaattttaaaggaacataaaattgagattgatgagcattgctattatgtagatacagagtatattacatatccgattccgtatgtaaatacaatagagtttgtggatggatttgtctatatgtaccgtttgggaaggcaagggcaaagcgttagtatggagaaaatgcaatcaaatgaaaaaaactatgatagggtaatggaatcgttattagcattttatgcaaacttagagtgtcaatcttcatgttctcaaaagaaaagacaatatattgcacgagtcattgcacgagttgctgctgggaaaataaagattatgttgagttttccgccaacaagttcgaaaaaagcatctttgatagagtttgataattacttgaaactcagttatcctgcgatatattataataatgtaaactcatcattaaggctccttagatattcccactacttactttatacggcagctagtatattagtcagacggaaatataaataatctaattaaatgtaactttattgaaaaagaaaggcacaaaaatatgggtcgaatgatagacagaattaatacatttaaacaatataaaccattgctagaacaactggttttaaaggatattaaacttaaatatcggagatcttttttgggatatttatggagtattttaaatccgttgatgataatggttattatggtaatagttttttctaatatgtttcgtttcgatataattaattatccagtatatttgattatagggcagacactttttggttttgtttcagaatcaactaatcaagcaatgtggtcaattacggggaatgcagcattgatgaagaaaacatatgttcctaaatatatttttacgttatcgaaggtaactagttcgtttgttaacactgtgttttctttgggagcgatgattatagtatttgttatatgtaagataaaaccgaataccaacatgttatttattccggtgatactttttcagatgtatattttttgtacaggattaggaatgatattggctcaagggacagtcttttttagagatattcaatatatttattcagcagtgcttacagcatggatgtatctcacacctattttttatccaatacagcagttaccattatcacttcaaaaaatcattaagcattttaatccgctttactcatatattacacaatttagaattatagtattggagggagcatttccggatccgagactaatattgtacggttttgctgttgcatttgcagtgctgattgtgggaactattgtattctttaaaaatcaagataaatttatattatatatataagaaagagtgtgtcaatgaagaatgaagattatgcaataattgttgatcatacaacagtacgatttaatatggcttccgaacgaatcgacaacttaaaggagtattttgtaaagcttgcaaaaagagaacttatgtttaaagaatttttagctttaaaggacatttctttaaaagtgaaaaaaggtgaggcatgggggattgttggtactaacggatcaggaaagtctactcttttgaaactgatttgtggtatccttaaaccctataagggaacggtaactatcaatggttcaatggcgccgttgattgaattgggggctggttttgaccctgatcttacagccagagagaatatttttttgaatggtgcagtgctcgggcatgataaatattttatgcaagaacattttgaggaaatagtcgattttgctgagttgcagaattttttggatatgccaataaaaaattatagttctggtatgtcagcgagattgggatttgctgtggcaactgtaactagaccagatatattgatatgtgatgaggtccttgcggttggggactatgcatttcagcagaaatgtgaaaagaggatgcaggatatgcgggattctggaacaacattattatatgtttcacattcagcagaatcagttaaatctgtatgtgagagagctttgtggctaaacaaaggagagtcagttatgattggaaatgcagaagaggttatggatcattatattgaatttctggagtgctaatgaaaattttaaaacatttttttgtttctacaagaagattggttgaaaaaagaccattccttaaatgttgtctcaaatttatatatagattaccacatagggagtttcaggaatatgtggcaaggtatataccgactatatgtgtgaatgggaagactattataactagaaatatatctgtagtgacgtttggacaaaaaaatcctaatagagtaattgtgttgacagaaagagattcgggatcaggagggttttgtgcagaatggatatattggcttaataggctgtgcttttctgaacagatgggttttttgcattgtattagttggataaatagccaattttttgtagagaatactatgcaaaacgtcaatatatttgaacattattttgtacaaccttatggattggatgttgaagatgtaaaacaaagcaaatacgtgattttagataaaaatagtatagattacggatattatgatgtatttgctcccggccgtgatgacgattatatgataacagatgaggatttttataagttggctcagatgcaaaaaaaatatatacgcttggaagcaaagataaaggaggagatagacagggatatatcccagatgataggcacggacaaggttttggcagtccatgcaagaggtgcagatgcacaggttcattataagaatcaccctatacctattgggatagatagatatatagaagagacagcgaaaagtatggctttgataaatgcgaataagatatttttggctacagatgataataatatattaaaagcatttatagataagtaccaagaaagtctaatttattataaggatgttgagagatccgatgggatgagaatgagctgttatggtgaagtagaacgtgaaaaacaccattatagattggggaaagaaatcgtaaaagatgtatatacgctggcggcgtgtgaaggccttgtatgtagctcctcgtatgtaagttatatggcaagaatagttaaaatggcctcaggaaagacttaccaaacagttaataatataacttcaactataaggacaacgggaatgaatctcaccgatcctttcactataaaaagagtagaggcaatatggaatcaagaattggaagttgcaaaaaaggagagataagatgaaaaaggcattgattacaggaataacgggtcaggatgggagctttttggcggaatttttactaaaaaaagagtatgatgtccatggaattatacgtagggcgtctatttctaatactgcaaggatagaccatttgatagaaagccaatgtgttacccttcatgaaggggatttgacggataccagcagcctgattagaattattggattggttcagccggatgagatctataatttggcagctcaaagtcacgtgcagatcagttttgatgtaccggaatattctggagaggtagatgcgataggcgttttgaggctgttggaagcggtcagaatacttgggttatcaaaaacttgtaagatatatcaagcctctacatcggaacttttcggtaaagttgaagaggttccgcaaagagaaactacaccatttcatccgtatagtccatatgcggtggctaagcaatatggtttttggattgttaaggagtatagagacgcgtatgggatgtttgcagtaaatggaattttgttcaatcatgagtcggaaagacgaggagaaaattttgttacaagaaagataacgttagcggtggcgagaatagcgtgtggtttgcaggaaaaattgtatttgggaaacatggattcactgagagattgggggtatgctaaagattatgttgaatgtatgtggttaatgctacaacaagaaaaaccggaagattttgtaatagctactggggagcaacatacggttagagatttcgtagaaagagcctttaaacgggtcggaaaaaatattatatgggaaggctctggaatagatgaaaagggaatcgacagcgaaagtggcacggtgattgttgaagtagatgcgaggtggtttagaccaacagatgttgataatttatggggagatccaactaaggctaaaactgttcttggatggaatccgcagcaaaccagttatgaagaactgattaacataatggtagatcatgacatgaaaatagcagaaagggaaatgaggaataaataattatggaatttaaattatgtgacaatccatgggggaacgaagaaatagccgcaatagaaaaagtgataaggtctaatatgtatactatgggccaggaagtgagaaagtatgaggaagatttcgcaaagcggtttggtacaaaatatgctattatggtgagttcgggttcgactgccaatttgctcgcaatagcagcgttagtgtattcacatagattgccaagagggagcgaagttatcgttccagcggtttcgtggagtactacatatgcgcccttggaacaatttggcatgaaagtggtgtttgttgatatagataaagaaacgttaaacatcgatttgaattcgcttagaagaaatataacaaataaaactaagatgatacttttggtcaacttattaggtaatccgaatgactttgatgttataagagatatgtgtaagggtaaagatataataattatggaggataactgtgagtcattaggagccaaatacaacgacaaacaggccggaacatttgggatagtcggaacgtactcatcattctactcccatcacatctgtactatggagggtggaacagtggtaacggatgatgatcaattatacgagtatatgctggcagtcagagcacatggatggaccagaaaccttccggataatagcactatatatgaaaaaagatcagatccattctatgagagtttcaactttataattccgggattcaatataaggccgctagaaatggaaggggctatagggcaggaacagctcaagaagatggatggtatgataaaacaaagaagaaagaatgcagagtattttaagaatagaatgcagaaattcgaagatataagaatccaaaaagaaataggggaatcttcttggtttggatttgcattgcttcttcagggaaaactcttagggcagagggataagatcgttcatgcgttaagggagaatggtattgaaactaggccgatcgtggctggaaactttaccagaaataaagtgattgaatatatggactatagcataccagaaaaactggttaatgctgacgacattcactttaatgggttttttatcgggaatcatagttccaataataataaagaaatagattattttataaaggtactggatgaggcaattaaacaatagaaagaaaagcagatgaataaacaagataggatatatgtgtctggacatacagggttagttggaagtgggattgttaaagaattaaaaaagcagggatataccaatttggtgctgcgtacgcacaatgagcttgatcttaccgatcagcgagcggtagaggtgttctttgataaagagaagccagattacgtgatagtaggtgctggattagtgggggggatcaaggcgaatagcgaagctccagcagatttttattatgttaatatgcaaatagcaaataatgtaatttggtcaagctataagcataaagtgaaaaaattattatatcttggtagtgcatgtatgtatccaaaagagtgtgagcagccaatgaaggagaggatgatcttatcaggatatcctgaagctacaaatgaaggatacgcgttagctaaaattgctggcacgagattgtgttcatatctccataggcaatatggtgtagattatatatctgcaataccagctaatgcatatggggtaggagattgttttgatccggataagtcgcatgtaattccggctcttattatgaagtatcaaaaggcaaaagagcagtgtgatgataaagtgattttgtgggggacaggaagcgcaaagagggagtttatcaatacaagggatatcgcgttagctagtatttttctgatgaataattattctgccgaggaaacaattaatgtgggcaccgatgaagaggtaacaataaaagagttgtcagaaatgattagagatatagttggatttaatggccgtatagaatgtgatatcagcaaacctgatggtatgccacgcaggatcttggattctacgaagatacatgctcttggatggagttcatccgtggcgcttcgggatggacttgaagaattgtatgaggattatataagtaaacgaggatgatattatgctgataccagaagtgggatttggaactgcggatttggcggaggatgcagaggaagccatatatactgctttgacacatgggtataaagtgattgatacggccagagcatatggaagtgaagcggcagtagggcgggcgctgaagaaagcgtgtagtgatggcgaacacaaaagagaagactatatcatacagacaaaagtaacgcctggcgtggttggatatcaggctgttttggatgattttgaacagtcgttgtcaaatcttggagttgactatgtagatgtatattttatccattggccggtaaacagaggcagtgaaaaaacatatcatcatgagaatgtggagatatggagagcttttgaagatctatataaagctggaaaagtaaaaaatcttggtgtatgcaattttttagaaaggcaccttgcagatattttggataattgtaaggtgaagcctacagttcaccagttggagatacacccaggatatcaacagataggtctggtacaatattctcaaaaaatgggaatggatatagaagcatggtctcctatgggtagaggagaactaaatagtaaagtgtatatggatatggcggataggtacaactgtaatgtgggacaacttgcgctgagatggagtttgcaaaagggatatacgcccttatcgaggtcaaagacaaaagaacatataattaataataagtttttggattttactatctccaaggaagatatgaagaagatagatgagcttaacactaatacgaattatctggatatatggagctataaacgacaacaaatgtattgactgcactacataaaaggagatatagtaacatgagagtggcagattttcttgcagaaaaattgaatagtgttggaatagaagatgtgtttatattaactggtggaggacttatgttcctgaccgatggagtagcatgtaataaaaatcttacccctataccgtgtcttcacgaacaggcagcttccatgtcggctatcgcttacgcacaaataagagaaggatatggctgctgctatgttactacggggtgtggaggaactaatactataacaggtgtgttgcatgcatggcaagatcatgttccggtaatatttgtgtcaggacagtgtaatagaagcgaaatgatgtcaatcgctaagtctaaagttcggcagataggacttcaagaagcggatatagtctctatagttgagtctataacaaaatatgcagtgacaattatggagccagatgatgcagtgtattgtatagaaaaggctttatatgaggcgaaaagtggtaacccagggccggtttggcttgatatacctatggatattcaggaagcagagatagatcccaataagcttaaacattttgtgccagaacaaaaaataaaaacagaatgtactgaagatgagattagttatgtgattcgagcgctggaagaggcagagagaccgattattattgttggacagggtgttaggcttgcaggtgcttgcaaagaattgtctgaattcatcgataaatatcagataccaatggtcggaacacgtatggggtgggatatatatccaagaaataatgatcttaatattggattggtagatacaaggggaactagagccggtaactttgcagcagaaaatgcagatatagtggtatgtataggaagcaggctgtctatgatgactactggatatagttataatctgttccttagaggggctaaaaagttcatagtagttgatatagacgtagaagaacataagaaggatacagtgcatattgataaggttatcaatgcggatgctaaagattttatatctaaattaaaagggattaaattaaaagacattagtgcatggcgtaataagtgcttgtattggaaacagaaatggcctatgattacaaaggaccatgaggatgataactgtggaatcagtaagtttgcatttattggtgtgttgaacaaacatcttagattggatagcgtaattacgactgatgcgggagccacaactgagattcccatgcaggcacttaattttacaagtgctagacaacgatatcttggtagtgcttcccagtgtgaaatgggatattctataccagccgctgtgggagcttcagtgggaagagataagaaagagatattatgcgtagttggggacggcagtttacagctgaatatccaggaactccagacaatcgtgacccaaaaacttccaattaagatatttgtttggaataataatgggtatggaacaataagagggcatcagaagaccatttttaaaggtcggtatgtcggtgtagacgaggcaagtggtacggcgtttccgaatttggaaaagatatctgccgcatatggaattagatatgagtcagctgctacattaaaagaacttgatcaagttatgaaaagtgtaataggcagagatgaacctgttatagttgatgtaaaatgctggattgaggaatttaatcctatagctaaagcgcaagtaaggatggaggatgggactaaagtagcgatgcctttggaggacatggccccattcatggatcgagaagaatttgaaaatgaaatgatagttaagccgattgtatggtggaaaaaatagggtaactacaaagatggtgagagacaagaaagaagaaaaaaatattcatatattgaggcctttgtatgttccggttagtaatgcaattagacgcacctttggaacaagaggatatgtttttgcaatatgtaagttcttgcgaagattgcctgaaatgtattttagaaactatattaatagttatagaagcccatatggttataaaagcattgacgaagaaagacataaagtaattaatatgcaagtacatgttcttggtgacaataataaagggaaagtaataatgcttttggagaatcaatcgcatcatgccggcttttgcgctatatgggtgtatattttaaataggctttctttttcagataagatgggattttatcatgttatagattgggaagaaagcgagttttaccaagaagatcacccgatacatggatcaaccagtatatttgaatattattttgaacagccatcaggaatatcccttgcggatgctagaaaaagtaattttgtggtttatgattggaatagtcctgaatacggctataatgatgcatttcatgtaggtgataataatgattacagattcacagataaagacgtggagcaatttgcgaagatacaacgaaagtatatacatttgcataaagagattgaacttagcataaaagaccaagtggaaaaattgtttcagggaaaaaccaatgtgattggtgttcatgctagaggggcagacactaagataggatacaaaggacatccaactatcgtgacatcggaagattatataaatgagaccgagaaaatggtaaagaaattcaaagcagatatgatattcttagcgacagacgatcaagtaatgttggatcagtttaagaatgcttttggaaataggcttgtatactacgaagatgttataaggtcaaccagtactattatgaactgttttatagaagaaaagagagaaaatcatcactatctgctaggtttagaaataattagagatgtttatacgcttgctgcgtgtagaggatttgtatgtggtatgagttatgtaggattcatagtgcaaattataaagaaagcaaatgaagaatgttttgatgattttattagaatttcaaaagggataaatatggacggattagatctaaataagagtactgttagaaaaaaaattggaaatgactggaaaaaagaattgaaacaaaaaggacgtatctaataaatcgttttaaggaggataaaataatgaataaaattcatcttttagattgtacgcttagagatggcggatatgtaaataactgggaatttgacaatggcgttgctaaagagatcgttaatggtctttataaaagtggcatccatgttatagagataggaattatgggacatggtgggaaagtagggaaaagcacgaaatttgcctcttttaaagaggctgaatcgttattggaaaatagaaaaaaggattgtaaatacgcaattatgcttaatcaagcagaagcagcgagttttgatataccggctagaagtgaaaaaacagtggatatgataagactggcttactttaagtcagaatttcaaaatgctattgtattagctaagtcactgaaggataaaggttatgaagtctttttacaggccatggcaacatttatgtattcagatgatgaaatgaatgatatgcttaggcaaattaatgatatgaaacccaaagcattttatattgttgatagttttagtaatttattccctgaggatattgcaagaatggccaaacaggtgttgctgaaacttgataaagatatagactttggttttcacgcgcataataatattcagatggcgttctcgaatgcaataacttttatggatgttgagagcgaccgtgatatatatattgatggaagtatatatggaatgggcagaggagcagggaatgtgccaatagagctacttatggattacctcaataaaaaggagaagctatataatctggaagttttattaaaaacataccaagattatataaaacctatttttgaacagtatttttggggttatacacatccgtattacttgacggccagtaaagatatgaactcagtatatagttggtattttatgaacaatggtattaatgacattgtgcggttaaataaagcgcttgatatgatttcggacgattcaaaatatgcgctgatgaaagatgaggcttcagaagttgtaaaaaaaatccggggtgagaacggatgaaaaatgaaattaaaatattgagaaaatccatactggatatggcgtattatggacaggatgcgaatctacagagtattttttcctcagtagaaattttgtggacactatactatgaggttatgaattataatatagataatatgaatgatcctaatagagatgtatttgttttaagtaaaggtcaatctactatgggagttttggcaatccttgctcagaaaggtttttttgataaagaagaactcaaaaaatcctgtcaatatgattcctttatcagtatgcaggcagatagaacaaaggttccaggatttgaagtgtccgcgggcagcttgggacacggtttccccattgcagtagggatggcttatgggaaaaaagtgcagcgtcaagatggacatgtatatgttctggctggtgacggagagatgaatgaaggcactatgtgggaagcagcattgtattgcggtagcgaaaggctggacaacttaacattaattatagatgacaatcattctatagatgttatgattaatataagaaatatacaggataagatgagagcttttggatttgaggtaattattgcgaatggacatgatataacagacatgagaaaggcattgttatttcggcagagtaataagcctgtagcaataattgctcaaacgaaaagagggtatggttctgctacaattatgacagatgacgcatggtttcatagagcaccgtcagaagaggaattgactagactcaaaaaggaagttgatgactttgaatagaaaaaattcaccgtacaaggtagttaagtccgaggtacataatatagggagagtaaccgtggtgaaggatactttccttattgaaggagacgagtatccatatacatatgtaattaataaggatagtgtgtgtattattcctatagtaggagatcaggtgattgctattgaacaataccgatatactttggatcagtggatgcttgaatttccggctggtagtgtagatgatggagaatcaagcgaggcagcggctaagagagagttggaagaagaaacaggttatatttcagaaaaacttatttatatgggcgaatattatatgaatcaagggatatcttcagcgaaatgcgatttgttttttgcaaaatgcatagacaaaaaagaggaatgtcgagaaaagacggaatttataaaaactaaacttataccgatcaatcagtttcaagaattgatatttagtaatcagtttaaattattgatcgggatagccggttggaacaaagctcaatatatgggactggtataaaggagaacgtaagtgagaacagcaatgaagtcatgtgttatagatatgattcgtaaccacagtaatactatgtgtatactcatagatataggtgcatttggatttaaggatttgatgaaaagttatccagagagggtgaaaaatattggtatctttgaagatggtctagttggcgtgtccgcagggctggctttgtctggtctggtacctactatatatggaattacaccttttattgtgcaacggtcactcgaacaactgaaacttgattatatctaccaaaatgtaggaggaaattttataacgacaggggctgcatatgatttttcaaaacttgggtattcacattattgtccggaagatgttgaaaccttaaagacattgccgggtatagagatacttacgcctggaacgccaaaacagtttgaaacgttgtttaaacagtgctatatgaatggaaaactctcatattttagaatgatagatcactgtaataaaacacaagtggatatagaatttggtaaagctaaagtattaaaaaagggtactagaggtacggtaatagcttttgcagaagcgctagacgcaactatcgcggcttgcgaaaacttggatataacattactatactatacaacggcggagccttttgatcttgaaacgttaaagagcaatattgttaataacagaatatttatatgtgaaccgttttaccaaggaacatttatggcagatattatgcctattttgtcaaaaagcagaattgctgtcgatggagttggagtgcctagacaggttatacgcacttatgggactaaagaagataaagatatgcaccttggattgacagcacgaaatataaatgataagttagcgcagtttttggagaaagaactatgaatataattctattatcaggtgggtcggggaagcggctatggccgttatctaatgatattaggtcaaagcaatttataaagctgtttaaaacagagcaaaacgaatatgaatctatgattcaaagaatctatagacaggtaaaactcgttgatgaagaagcagagataacaattgcgactgcaaaatcgcaggtatcttctattataaatcaactgggagataatataggtatatcagtagaaccgtgcagaaaagatacattcccggcgattgcgttggcggggatgtatcttcatgatattaaaaagataccagatgacgagacggtagtagtttgcccagtggatccttatgtaaatgatgaatatttcgaagcattaaaagagcttgacataattgtacaggatacagatacaaacttggttttaatgggtatagagccaacatatccgagtgaaaagtatggctatattatacctaaaactagagataaatttagcgatgtagaaatgtttagagaaaagcctgatgctaaaactgctcagctatatataagtaatggtgcgctatggaatagtggagtgtttgcatttaaactcaaatatatagttaataaggcccatcaattaatggaatttaggaattatcaagatctttatgataaatatcaatttcaagaaaaaatcagttttgattatgctgtagcggaaaaagaaaaatatatcaaagtgatgagatttacaggaaaatggaaagatcttggtacgtggaatacattgacagaggaaatgtctaactgtatacttgggaaaggtattcttgatgaaacatgtgaaaataccaatataataaatgaattaaacataccaattttatgtatgggacttaaagatatggtagtagcagcaagtaatgagggaatattggtctcaaataaagaacagtctagttatataaaaccctttgttgattctatagatcaacagattatgtttgctgagaaatcatggggatattatagagtcatagattatacctcaaatagcataacagttaaagtcacattacatagaaactgtaatatgaattatcatagtcatgagtatagagatgaagtatggactgtagtttctggagagggaacagccgtcatagattcaaaaaaggtagctttaagaccaggtgtagtagtcaacctgccttgtttttgtaggcatacagtaattgcaaaaacaaagcttgaaataatagagattcagatgggggaagggattactgtacacgacaagaaaaagtatgaatatgattatactaatataataaacgagtgggggagaaactaatgcggcaaccattaataagtgttattgtaccagcatacaatttggaggactgcttggggcgagccttagattctatcttaaaacaaggaataaaggatatggaggtaatagtcgttgatgatttgagtagcgatggcacttgggaattgataaaaaaatatcaaaaaagtgataagcgcatagtacctattcatatgaatcaacgatcaaagccatcaggagctagaaatgccgcattggaagtggctactggtaagtatattcatttttgcgatggagacgatgctattccggcaaaaagctataaaataatgcttgagatagcggaaaaagagaatgtcgatatagttacagggaactatatgaggatgtatccaaatgaaagaaatgcggtaaggcctttttcgcaatatacttcaaatacggcgattgaacgctgttttgaaaaaagtaatacaacattgtggaataagttatatagacgttcatttatcgaagagcatggcttgcgttttgatgagacacttagatatagtgaagatttgttgttttacatggagtttatgctaggaaatccaaaggcagggtatactgatgctaatgtatacatatacacagaaccaacacaaaatgtagaaattgatgaatctatcattggtgttcaacgatttgccaacaaactgtgtatgcaaaatggtatgtattgttatagccatgtttttgaaaaaccgctaacaaagaatatagagcaatggaaaattctgtatcgagacaatctaaattggcattatcagtgtgtttttaggcttataaattctccaaaagagaaagaagaagcgtatacatgtatgaaggatgaaataattaagattgctaaagcaaatccaggtgtacttgactggtcagatgcaaaatcatatagagaattcgtagatataatgcatatgaactttgcgacttttcagactttaacatatagagagtttttaatattggattctattcgggaaagagcaagatgcaattttagtggtgtaaatttacaggagttgcatgaaataattagtgaaatcaatattaaagaatcaaatgacgttgacaaagtgctttatgataagttgatagaacaaattaatgatataaaagcaagatatttaagtacaaaatatatttatcaaaaaaagctaattcaatcaacatactggactgaatggcaattagtagtcagacatacatgggcaccaatacagaatattgagttaaagaaaaacgcatggaatataatgcgggatactataactgtactttcagataatgaaatatgtagtttactttctgaaactgcgttttggaaaattcgagaagtgtttggggttgattacccaactcttatggcattaagttacgaagaatatatactggctactagcattaaagaagtaaaagaagatttgaatacagatgttcaaaaaatatttatagatgactcatatgctgggaatgtaggtatgaaagttataatgaaagcggctagaggatggatgacttttaagattaatagaaaacttaaaagataagctttgaaggagggcaggatagaggattatctggagcattaatttcaaataagtgctgattaaaatgtgggaaatgcacgttgaggatagggctgtcaaatgaagttgcttgctcttgatacagttagcaatacatggagaatagcgttttggcacttatagttatattccaagttttgatactaatggtagaagagcctattaaattaacctgcaaataaaaagttaattggaaattgaagattttttgaaaaatttccgtgcaggaaaaagagtacaacaaataggctgtcggtgtccgtcaaccagacaaagttatgtaagctactggctgctgaggaagagcatttaagtattctttggctcttccataataaatatggagaaacttgtttgcattggcagtcatgtatacatagtagggtttaccttgcgcttatctatgaataggtaaacagaggcattctatggctttgtcttgatcaggacatccatgacctggagcagaggcttgcgcagtgcaggtatgcttcgaggcatagacgattttctgtgaataatcgccggaataatttacgccggcaaatgcggtaatggtgcctttaagagtaaaagtgttacatcttcgagctgagccatgagtggggcccaagggaagggccgacacccctcatagccatgaccaccggataccccggaagcgtggagacagtctcgttcatcagaaaacggaactgttcaacggacagggaagccgcatttaactgactgacttcctggtgggtgaggcgtttggtaaaattgtcctttggaagtacaggggccagctccctagcgattctgtagatttcttcagccgttgctttgctgaagttgcacttcttatggctgtacctttctgataatggtcagtaaaagcattgagggacatcgtcaaagtctttaattggttgtgtatttcatctataagactatattgtatcaacttgactcacctattaagcgtgtaccgtgcgatttaaagggaatccgctttgtcggacttgactttgcgaagtggtgggccttgtcctggtaattgtatatggggtgtgggttcatagcgccgaaaaaaggctaaatgccgtaagctcccatacgatggggcataatatcgcccggcgcattccatgatgatacgggacttgccatcaagagatgagatacggctggccaatgactggatatgagcggacagatgggacacgtcggagggtttagccacaactttaccgcctgaacgggatggccatagtgcttttccatttagagacatcaatatctactgcgtccataatcataacaatatcacgcctttataatagtggcaatggcaagtaccagttttacttattgcctattcaatctactggggtataacgcgaacgcaccgggatggggggcacaaaagatgaacgctgtgaatgaggagctggttattagactaatctacggacgctaagtctaaggaggactccgatataccgattgcgttctgcattctaacagcttaagcatcaagatggatcattccttacttgctgtaatggatattaaccataaatatattgtagtaggaggaattaatatcataaattgataatgagtatgtttgtgctataaaggaccagatgaaattaagttgtgtggaaaagggataggaaatgaagactataaaaattaaatttgtagattttaatgccccaacatttgatgcagaaaatcagtgggttacaaaagtattaagagagcgatataatgttgagttttcggaagaaccagagtttatcttttatagcacgtggggactcaattttagaaattatccgaattctgttaaaattttttgtggtggggaggctgtttctcctaatttcaatgaatgtgattttgcctttggatttgaacctatctattataatgatcgcttttgtcaatatccgttaggagatagtgatagtccaggcctttatgacattacacgatccatacaggaccggtctgctgtaagcgctgatttgttggaacgtaaattctgtaattttgtttattcccaggactggatgggagaaggggctatcctacgtagagagttctgcaaagtccttatgggctataagcatgtagattgcccaagttatgtgatgaataatatgccccgtggtactatttcagatcgttggacaggtttatcttgtggcaacggtactgtatcatcagggtggagtgatggaaaattagaatttctaaggcgatataaattcaccattgcgtttgagaatactgcactatcaggctacacaacagaaaagattattcagccgtttcaggccttttctattccgatttattggggaaatccagatatattaagcttatttaatccgaaggcgtttattaactgtaatgaatacggaaatgactttgattccattattgagcgagtaaaagagctggataacgataacgataagtatcttgagatgctatctcaaccacctatgcaagaaagttttgactttgaccgtagagagaaagcaaaagagttcttgtacaaaattatcgaacgtgggccatatccctttgcaaaagatgccttacgaatttcatcctcatatagaacatttaatgaatacaaccgtgtgactgaagaattgaataccaccaaggaagcaatgaaacggatggggtatgattcaaactccaatacctggaagttagtacaaaaacttcaacggtttggtgattccaaatgggggtatattcctaaaaggatatttcatattcttatacgcatttataagaaactgaaaattgtaaaggcgagatactagtgtagaatctagttgttaaacagatttttgtgtgataatgttaaacaaaaaaggcggccatcgcacatggcaaaaacaagttcaaataataaacataactcaaggaatgaagacctccttagtgatgagcagatatgttttttgagagcattactttccacggataaaacaacacttacaattaataagcgtgccttaatccttcttgccatctacaatgcttccggtaaaaagtttacccactgccagattgctgaaagtctggatatttttacttcaaccgtacatcgtacgactaaacatttggtggacctggagtttgatgaatgaatcacgattcatcgcaaccccagacagaataatatctgtaaaatacagggcgaccagcaggctcgcctgatccagttggcctgcagtacagcatccaaaggccattccatctggtcccggcagctcttacgtgatcgggcggttgaatttaaaatagttgagccggttgcggtggagacggtatacgccgctaaaaaaatgaacttgagcctcacaaaaacgaatactgctgcattccctcaaagcaaaacgtagattgtgtagcctgtatggaagaaatcctggatacttataaactaccttacaaagaagaggttcctggtgtgtgcatggatgagaagccatatcagctgctggatcaggttcagaagcccttccaagtgaagcacggaagtattcggaaggaagaggccgagtataagcggaaaggaacctgcagtatcgctgtctttgtacagccccgggcaaattatcgccacatcagtgtgagaaaaaaccgcacaatggtcgattgggcgaaggaaattgaatattcgttcacagtcatataccctgataagaaaaaggtcatactggttatggacaatttaaacacccatacatatgtgccgttttataaggcgttcccacctgaaaaagccgggaactggcaaaacggttgaacacctgttataccctcaagcatggcaattggctgaatatagcggaaatcaaacttaatgtaatgacacgtcagtgtttaaagcgtcggatacccaatatagatagcctgtctgcagaactaacgcttggggaagcgtacggaataggggaaaaggaaccggaggttggcagtttacgacagcaaatgtaagaataaatttctagtctctttatcctaaggtggtgatatcgcaaatatggcactttatataaccaaaccattaatgagaactagttgatgcactaggaagattgtggggtttcaccgattgctacatgatgacattggtatagagtagattattaatattagaaaataataagatgttggatggttggtttttctttttatactagtgagaagaaatactataataaaattaagtagttgcgtgattgaggaggggaatatcgacctagcattatattattatattttatactaagacaacaatactttgccggaagtgattatttctggggcgctgcccgaaattttgaaatttatttatagcctgcgacttttgggaaataagaaaatttgtgaatagagaagtacagttgcataacttgtataggagtgtagcagtatcgatagaatagttcctacgaactttattataagtctccaaggactcttggcaagataagtaaattgtaaagtggatgaaattttccagtgatatttctgatgaaaatgtggatgggataactcatgcgtgatttatatttcattgcttatcattgtgttctgagactgccataacagaaaacacctcagtttatctatcttatgactgctatccgcgtcagttatccaccgtcattatgacgaactcccgatagtgacgaattcgtttatttcttcaatttatggtaaaatactagtaacgaaacaaaggggtgaaaggccatggtagccggtgcaaaggacatccggttcaaggagctgaaggatacgatctcacaactgaatacaaccacccgtaccccaaatgatctggtaatatccctgcagaaggtgctggaagaacgcaatgcaaaggacgatgaaagagactggatcatttcaaatctacaggcatagcttgaatactttaagcagaagctttttgacagcgccagtgaacgatgtagtgacatgcctggccagatgaatcttttcttcggttatgattcagaggaagaaccatttccggaactcattgaaccagagttcatcaaagttaagaacagcgaacaaggacgtaagcccaaagtgaactataacgagatgttcataaatctgctaacccactatgaagagatggatacactgacagacgaagaaaaccgtgtcctgcttgtggagccatgatgattccagccggtcatgaagaaatcaggacagaactgtgctataccaaagcaaagctggaacgtattgtgtgcgttgtaaccacttatagccgccctgtctgcaaggatacggaagaaccatagtttatcaaagatgaaggagtcccggcactgatacctggtggctacgtcccatcaccccttgtgtcgcacattatgtatgaaaagtacataggtgcgcttccattgtatcgacagaaaaaaggatttggactcctttgtgtcagcagcagaacgcccatagtgagttggatcatcacctgttccaagaagcatttgaaatctgtgtatgactgactactttcaatgtgagctgctgaaatggtatttcctgatggctgcagtggaagatttcatgcactggcgggatgcgcagcaccaagaaaagggaagccgcatggatgaagcagtgacttatctccgaaatcgaaaagacacgataatgacttatctcaaagacagttgatgcagcctgagtaataatccatcagggaatttaatcaggccgctaaccttaggctgcaaaaactggctgttcagcgacagccaggatggtgcgaatgcgagtatggaggtttataccatgtagagacagcgaaagtgcaagggcggcatccatacaactatctgcaatacctgctcgatagccgccctggtaaagatatttcgatgcagagttctgggatctcgcaccgtggagtgaaaaagtcaggatagaatgtaacaaaaaatcagagtaaaacgctcgcaaccctggcatcaaatgttggtgctagggtaaatgtgttgggataccctaacacttggcgtttacaataatatatgggggtcagaatgatgaaaaaaattagcatattgtttttttgttgttttttactactttgcgcgtgtacgtcagaaacagcttcacgagatgaaagtcctgaagaatcattttcagcttcaattgggttaacaataaatggatatacggtatatttaaatccaactatttctgataattggatagaaccgatgtcaatggctgcagatgctccgaatatttttgtgttttcgactttttctggttataaaataaaatgtaataatattgaagttcagagcggtgatactgtagaagtgatgatagataaaggatatcttaaaaaaagcgatggaattgaaattgagtttactaataaaaaaagtggattagtaaccaaacaatttgtgcgttgtttaaatgaaggatttcctgaattcattacgattaataatggtgccgagtacgggtattattattttgatcctacacaagactggattgtcaaaatgaatactaattcggaaatcatatattttaattattgtgaagataatttttatgattttaagccgattgagacaaaaaatggagaattatattatagttatttaacgccctattctgatccagatgaaaaaatcaaagtagttacaaattcttttactgaatgtaaagctgtcataatgaatagtaattaccaggtggtaaaagaaattttgggcacattagatgaggatggtaaatttactaatatagaactagatatgcacgagtttctgatgtttgatgaaatgaattatattacattgtcctatattccgacttatgtagataatattcctgaaaaactgacaggaagaggaggttacccgtcaagggtttatgctgcttatatacaggaggtgagagatggaaaggtagcatttgaatggaaaagtacagattatcctgagttttatgatatgagcgtagaaggtaatcagtttgactttactaatgaaggatggtgcgattatatccatataaacagtattgatatttgtccgaatgatggtaatttagttctttcaatgcgccacgctgattctgtggttgagattgaccggaaaaccggagatattgtttggatactgggcggaaaacatgatatgtttaaattgaaggaagaagagaaatttactaggcagcattttgcgcgttttacggatagtggaacgttaacgctgtttgataactctacaaattatgttgtaagtagtgccgaaaattatattggaaatgggaccggttttcccaggactatagaattttctcttgatgagagagaaaaaacgattttagattataaatcatacgactataaagtaaaacagagtgaggtaatggggtcgtcgcagaagttggcagatgatatttttttgattggatggggagcgagtatggaggttccatcgaaaatattgttttcagaaattgattttatttcgcagaaggtattatttgaagcctcaaacaaaagtggagttaatgtcacttatagagttcataagtttcataggtgaatttataaaatcaagaaaatgataaatatgaatgtaggtccggatagctgtcagattgtaaatagggcggttaaagatatgatggaagagcttaactgtttttttattgggggattgggtggtttttgggagggggggggggcgaaaatcaataatttattgtttctgaatgtattaaaccatagatcaaaaaggaaaggaaatatgttgtttttgcttctataaacaccatacaagattaaaatggatacaatcgtacagacaagatggaaaaactggttgtcccaaagcctgaaagacgctgatctaacagcggaactccaagcgatggcagaagatgagaaaacgattgaggactgtttctacaaggaattggagtttgggaccggagggctgcgcggcgtgattggcgctgggaccaaccggatgaatatatacacggtagcaaaggcgactcagggatatgctgattatctcaatgaatattttgcatctccatcagttgctattgcctatgacagccggataaagtcggagcggtttgcagaggttgcagccgaggtattggcggcaaacggcattcaggtttatatttatccggaactaatgcccacgccggctctttcctttgcagttcgaaatctgagctgttctggcggaattgtgataacagccagtcataatccagcaaaatataatggctataaggtatatggtgcagatggctgtcagattacgacgaaagcagctaaagagattttggcaaagatcaacgctgtcgatattttttccggagttaagagtatgaaatttgccaagggaattgagcagaaacgtatttcttacatcggagaagagacagtagaggcatttattcgtgcggtgtcagcgcagtccctgtgtggtgatgcggcctgtgataagagtgtatccattgtttatacgcctttaaatggaacaggattaaaatgcgtgttgcgctgtttgaaggaaaatggtttcacaaatatttctgtggtcaaagagcaggcagaactgaatggtcattttcctacatgcccctatcccaatccggagattagagaagcgctggagctggggctaaaagaggccaaaaggttgggcagcgagcttctgctggcaacggatccggactgtgaccgggttggcattgccgttaaatcgggagacgactttgttcttctcagcggcaatgaggttggaatgctgcttttggattatatttgcaaacgccgtttggccttaaagcgaatgcccaagaacccgcttgtagtaaaaactattgtgaccattgatatggcaaagcgtatcgcggcggattatggagtccaggttattgatgtgctgactggatttaagtttattggcgaacagattggattcttggaaaaaaaggggcaggaagaccgctatatcctgggatttgaggaaagctatggatacctgacggggagttatgtgagggacaaggacgcagtcaatgcctcgcttatgatctgcgaaatgtttgcctattataaggctaagggacaaagtcttttggatgtattgaacggactttatacaaaatatggatattgtctgaatacccttcacagttatgaatttgaaggcgcttccggattccgaaaaatgcaggatattatggaaaaattaagagacaactgtccaaaaacatggatgagacgtaagataatttccgttagtgattatcagatgtcaattacacgctataatgatgggagggtggagaaaattgaccttccgatttcaaacgtgttgaaatttgaactcgaagataatctttcggtggtggtgcgcccctccggaactgaaccgaagcttaaaatgtatatgtctgttagcgcaggaagccgggaagaggcgggcgatttggagcggcattttgtaaaggagcttgaagcaatgtttgcatgaatggcatagttttcggatcctcatcagttgtatagacaatgtatcatcagggaagctataaatgatcagagagaggcattaatatgagtaaaaacctgtcatggaaaatgttgtctgaggagacaattattaaagatccttggatcgaacttcgtgccagcacttgtctgttgccaaccggtttgaccatatctccgttttatgtaaatcatttgccggattttgcagtggttgtagcagtgacaccagatccagagcgaaaagtgattttagtgcgccaataccgtcatggggtggagaaggtattgctggagttgccggccggctgcattgaggttggtgagaaccccaaggatgctgccaccagggagctactggaagaaactggttataaggcggggcatatggaattcatgtttcagattgcccccaacgcgacaaattgtaccagctatgcacagtgctatttggcatgggctgcggaacaggtggaggctcaacatttggatgagacggaatcactggaggtggtgatactggagagcagtgaggtcaggcgccttctgcgggaaggtggttttgagcaggctgtgcatgtggcagcactgtaccgggccatggaactcggagcgttgtgagattttgtaggttggcttaacagcgggaatgaatggaaaagccttaatccaaatcttaaaagtctatttatgcaccaatgtaaccacaaaagccggagcagtttcataccctgctccgattcattttgttcatttattttccaatcattcaattatgcccggtggtttataaaatgctgcacctaaactgactgggctgttgtattacccattataaatccccgcaatcacccccaccaccttctccacccccaacttactcaaattaaacaacatctggtgggattcaatgcttccccattcctgcttggtataattttcataatacttccgcctctggctgtccgtgtggcggacggcgctggcggcttccttgcgtgggatctggtagcggtccatgatgcggcttatgcggtcctccatggaggcgcagaggaagacatcgatgagatccgggtagtcccgcagtatgtagtctccgcagcggcctacgatgatacaggggccttccttggccagggtttcgatgatggcggtctgggtcaggtaggtgctgtcgtttaaggggagaccgtagccggttacgtcgttgggggttttgggaatccggtaggtggacaggaaagagtgaagcgcagcttcatccacttcctctaccgtgatgggggagaggcccattttctctgcggccatctcaaccaggctccggtcataaagggggatctgcagaagtttcgacaaccgttccccgacttcgtgtccgccgctgccgaattggcgggcgatggtgataatcttatgactcataagcgcgctcctttctgacaagtgtgggaatataataagatatacttctattataatgcataacatgaagaaaagatagcgaaatgtcagaaaatatgcgcggtgagaatgcatgttttacttgacaaacccgctcccgccggctcctatatcaataatttgatttcccgcctcaatgctccttttgcagtcccggaatttcccgtgtggctgcggcctctacccctgagtgattcgcctccgcgccggagtcaactacatccacccctgcctcagccttcaccacaccgtctcccggatggttatcgaccgctccatccgccttccccgccgtctccgcgctcctcttctccaaccccttctgcgcacgcagcatatcccaaatcgtatcgtgcatccagctgaccgtgtcgctgagtattttgttctccgcgtccagatccatgataacgttgcacagctctgcgatggtctcgcggctgttgaagcgcttgtggggttctgtgatgcgggccatgatggagggattccgttttaacatttccatggagagataattgtcacgttcctcacatgtcatattcataaattcggtatagtacatctttaacatgcacatggctgtgcggccgtcgccgcatttgggacagaccggatgccgggatgtctggtagtatgcgtaatgaccgcaatccgggcaataaaataccgctagttcgcgcataaatgaatcctccctttctatttccggatcccagtgcggatttgaaaccggtcgtaccgcggcacaaagcgttttcaaaccggcactgggcttacatatgtaatgccgattgccggaggcatagcccccctacatactatttataacgctgaaatcgtcaaaatatacctcgtgattagagaaaatacaattttttggcaaaatatacaaaaatacggcaagacttttagcaagtctgccgcattttcgtctccctttttatcggatgtcgtcttaacgtgtttgaacggatgtgtgtatcaggagggagatggttggtttttcatggctgccatcgcggcagccatggaaagaggcagggcgcgagcgccttactgctggataacgccctcggtgctgacaacccagatcttatcgttctcatccttgtaatccttgaaaccgttgcccagttcgggcttggtgctggatttggaggaggagctggctttctgcacaacgccgttggcgtttaccaggtactgattgccgttcagctctaccggaacgtagcgcaggtccttgtcggcttcctggcgcaggccgtagatatacagaacgttatccttgatcccgtggtaaccctggccctttctggagccgtcggtgtggaagtaccagttctggttctcgtcgtttttctcatcgtagattacctgcttgccggtgcgcattacgccgtcctcgccgaagtagaagttcgccacctcgccgtcgccggtgttgacaacctgtttgccggtctgcatttcacccttggtgttaaacgcatactttttggaatcgatggagaacagctctaggccgctctcggcgtagtagggcttgccgttcttgaagtagaagcggtaggtctccccctcttcgctgattccctcaacgccctcgatggttctccagtcggaggcgcgttttccgtcctcgtcgtaatactggtagcccgccacgctgttgttcgcgggagttgcctcggaggcgctggcagtctccgttaccggaagcttgtaccagccggtctgcatacggccgtcctcaaaggtgtagtatgcgccgtcaatctttttatcgacctggttttccacgcgcttgccgctgcggtcatagtagaaccaggactcagtgtaatcggaatcttcgttttcatcctccagctggatccagccggtcttcatcttgccgtcgccttcttcgcccaggtaatagttgaagccgtcaaggctgatttcgccggtcatcatgtggccgtcttcattgaagtagtaggtgcttccctcgatggtcatccagcgggatgtggtcatttttccgttttttccgtaatagtaccagtaatattccggctcgctctcatcgttgccgtaatcttcgttttccacggagatccagctctcggtgacgcgctttccgtcttctcctacgtaatactcatctacctgcgcattgatcgcctgcattccctcggaatccagatagaaccagtcgtcgcctctctttttccaggtatccgtcagcagatcgccgtcggaatcgtagaacacccaacccccattttcctgagtccagcctgcgcttgcagcgtatacgctggatacgggagcgttggataagaagttcggggcaaatgccgccatgaacgcggtagtggataatacagccagtacttttgtgtgttttttcataatattgatgtctctcctttttgatatactgttttggattcgtatgtggccgaaaatccgtcgttgcattacaatcatgattatagcggacgcgggggcatttgaatagtgagggttattggaagttctggaagcggctggggaggggagaaaatgaacggggcgcgcgggtgcgcgaggagatccgcaggggtcccccgccgggcgcggcttaacatggaaaacagcgtattgccccgctgcagtccggcatagaaaacggtttgtccatccgggcgcggcagcgcgcacaaaacattttaatggcttttggcgtgtcccgtataccctccggccacgaaaaacagtaggattttgcgggaagttatgctatactcacgttatacaaaattgaccgcagaatcagaggagaagatgtttatgaaaaaaagattgtccgactatattgccgatcggttggtggaggcgggaatttgccaggtgttcacggtgaccggcgggggagccatgcatttgaatgacgccctgggacataaggaagggcttcactgcctgtacaatcatcatgagcaggccagcgccatggcggcggaggcttacgcgcggattcacaaccggattgcggcgctctgcgtgaccaccggcccgggcgggaccaacgcgatcaccggggttgtgggtggctggctggattccattcccatgctggtgctctccggtcaggtgcgctacgacaccacggcccgctggtccggcgtgggaatccgcgccatgggtgaccaggagtttgacatctgcaagtccatcgactgtatgaccaaatacagcgagatggtgatcgatccggagcgcatccggttctgcctggagaaggcattgtatctgtcccagtccggccgcccgggcccctgttggctggacatccctttaaatgtacagtccgctcagatcgagatggaggcgctggtgggattcgaccctgcggcctacgaggcgggcgggaccggctggggcacgaaagaggcccaggattcccacggcattcccggggattttgccggaaaaggcgaaaaacgccaggttctgcccccgccggtgtcgcgggagacggcgatggccgtgatcgaaaagatccgcgctgcgcagcgtccggtgatcaacgccggaaatggaatccgcatcggcaaagccttcgacgtgtttgaacgtgtggtgaacaagctgggcgttccggtgattaccggctgggacagcgaggatctgatgtgcgacgacgatccgctgtacgtgggccgcgcgggcaacatgggcgaccgccccgggaattttgccattcagaacagcgatctggtgctgagcatcggcagccgcctgagcatccgccaggttggctacaactacggcacctgggccagagcagcttacgtgattgtcaacgacatcgatgaggaagagttaaagaagccttcggttcacagcgatatgcggattcacggggacgccagggaccttttagagcagatggacaaggtgctggacgagattctgaccgcggaggggggacgcaccgggggagaagccggctggaaaccgttctttggcggcggccaggggcttgccggcatgagctggaacgagacctgccggatgtggaaggagaaatatccggtggtgctgccaaagcattttgcgcacagtgatgaggaaccagccaatgtatacgccatgatcaaggagatcagcagccgccttgaggagggccagatcacggtggttggaaacggctccgcctgcgtggtgggcggtcacgcctgggtgattaagaagggccagaggtttatcaccaattccgccattgcggccatgggctacgacctgccggcggccatcggtgtgtgggcggcttccagggaccagcagtgctaccaacagggcgaccgggcgaccgggaaggacctgatcctgctcaccggggacggcagcatccagatgaatctgcaggaactgcagaccattattcaccatgagatgaatattaagatatttttgatcaataacggcggctatcattccatccgccagacccagaagaatttcttcggggagcccttggtgggcatcggtgtggacagcggggatctgagcttcccgtccatggagaagctggccgcggcctacggctatccctatgtggccgcttaccacaacagccagctgccggaggcggtggagcagacattggccatcgacggaccggtgatctgcgaggtgtttgtcagccgggaccagaatttcgagcccaagtcctcggccaagcgcctgccggacgggaccatggtgtctccgcccttggaggatctgtctcccttcctgccggatgaagagatggacgccaatatgatgattcccaggatcaaggaataaggtccgggactgtgaaggagtatgtgacatgcgtattgttgtgaccggagccaccagttttatcggcagggccgttgtggaggaactgctggaaaaacgccatcaggtgtttgcggcggtgcgcccggattcggccgggcggggggaactggaagcaatgcagcgggagaccggcgggcagctgactgtgcttccggtggatcttagcgcctgcgggacgctggaccgccacccggccctggagggacgggcggacctgtggctccatctgggctgggagggctcggggagcgccaaccgcacgaatcctgagattcaggcccgcaacattggttatgccctggaggcgttgggggcggccgcgcgtctgggctgcacccgctttctgtttagcggttcccaggcggagtacgggattgcggacggtcttatgcgcgaggattccccctgccatccggtgtcggagtacggcaaggacaagttagaggtctgccgccgggccggggagagggccgcagagctgggaatcacttatctgcatgcccggattttcagcgtttacgggccgggagaccatccctggtccctggtgtccagttgcgtggacacctttttaaagggcgggcatatggagtttggagcctgcacccagctgtggaattatctctatattaaagatgcggtccgggcgattaccggtctgctgcttgcaaaatccccttccggcgtgtataatgtggcgggtaacgacaccaggccgctgcgggagtttatcggggaaatccaccgcctttgcggaggccgcggcacctttgagtacggaaagcgcccgcccaacgcggagggcgtggtgtccctgaacccggatacggggaaattataccggactgcgaattttcagcccaggatctcctttgaggagggaatccgggaaatgattgccaaccatgagttttataaggagaatagcaaatgaaacgatgcatcgcctgcggcgcccctttgtgggagacgccgctgcttacgctagataacatgcccgcttcggcccagcacatgccggatgcagagggcgttaagacggacgaagggctgactctggacttatgtcaatgcgccggctgcgggctggttcagtttgactgtgagccggtggattattaccgggatgtgatccgggccgggggattttccaagacaatggtggagctgcgcagataccagtaccggcatctgatcgacacctaccacctggaaggaaaacggtttattgaggtgggctgcggacagggtgaatttttaagcgtgctgtccgagttcccggtggaggtccacggaatcgagcacgatcccaggctggtggccctggccagggagcgcggtctggatgtgacggaagggtttacggagacggaggacacggtttttccggacgggccttacgatgtgtttttgtccttcaattttttggagcaccagccggatccctgcgccatgctgcaggcgatccaccgcaatctggacgacgacggcatgggcctgattacggtgcccagctttgagtatatcatggaccacaacagctattacgagctgatccgggatcacatcgcctactatacctttgacaccctgacaccgcttctggagcggaacggttttgtggtggaggaatgcgagatcatcaaccgggacaccctgtcagtagtggttaaaaagcgtccgcagatggagacggggaatctgctggaatgttatgtgaacctgcgcaaggaaatggacacatacctgaaatacctcaaggcgtggaataagaaggtcgccatctggggcgccagccaccagggcttcacgctggcggccaccaccaagctggggaaaaaggcggagtacatcatcgattccgccccgttcaagcagggaaaattcgcacccgcgtcccacctgcccatcgtaggcccggaacattttgaagaacacccggtggacgccatcgtgatcaccgcaccagggtatacggatgagatcgcagcaagcatccgggagcggttcggcaaagacgtggaagtccgcgcgatgcggttcaatcacctggagacgttataagagttcccttgtcctaaggggtaccaggcaaagcctggtggattccttaggacggccagcgaattctaaccgttggattatggggtaccaggcaaagcctggtggattccttaggacggccagcgaattctaaccgttggattatgggtaccaggcaaagcctggtggattccttaggacggcccgcgaattccagccgttggattatggggtaccaggcaaagcccgatggcttccttaggacaccccgcgaatcccctctacccaacacataaaaagaaaggatccctccctctatgaaagcattcgtactaaaaaaaccaggagtagtcggctggcacaacgctcccgagccgtctctcgtcccttacggagcaatactcgccccggtggctatgacgccctgctcgtcggacgtgcacaccgtgtacggcggggggtcgcccaaggcgcccaatctgattctgggtcatgagtgcgtggcgcggattctggaggtgggggaccaggtgcgggatttctctcccggagagatcgtcgcggttccggccatcacgccggactggcgggctctggcgatccaggagggcaacgaccgccacgccgggaagccattttccggccaccagctgggcagaacccagccgggggtatttgcggagcggtttctgattccggacgcggacaccacgctggcgaagattccccagggagtcacgctggagcaggcgctgatgtgcgtggacaccatgaccaccggctttacgggagcggaatacgcggatatcaaggccggcgataccgtggtcgtgctgggcatcgggcccatcggcctgatggcggtggccggggcggcccacatgggcgcggcgcggatcatcggcgtgggaacccgcccggtttgcgccgcgttggccagagagtacggagccacggatgtcatcagctaccgggacggggacgtggtggagcaggtccttgacatgacggacggtctcggggcagacggcgtgatcatctgcggcggcggggacgaggtgttcacccaggccgtggacatggtgcgctacggcattggaacggtttccaatgtgaattattacggcggaaccggctccatcggctatccgaaattttccggcggcagaggcatggccggaaagaccatccacatggagctggccagaggcggccgcgcccgcatcgagcgtatgctgaaaatggttcagtacaagcgggtggacccggggaaaatggtgacccaccggctgcacggcctggacaaggtggaggaggcgttggagcttatgcaccacaagccgaaagacctggtcaaggtcatggtacaaaacgattgaacgcaaatacgatatcctggagtaaacgagagataatatgaaaaccataagtattgtagtgccttgttataatgaagaagagaacgtaatccccttaagccgcgcgatcacggccctgtttgagaaggagctggcggattaccggtacgagctgatttttatcgacaatgattcgagggaccggacccgggaactgctgcgggggctctgccagagcgacccggacatcaaggcgatttttaacgccaagaatttcggccagtttaattccccctactacgccatgctgcagaccagcggggactgtaccattctcatggcggcggatttccaggacccggtggagatgattccccagtacgtgcgggagtgggagtccgggtataaaattgtgatcggcatcaagaagagcagccaggagaacaagtttatgtactggctcaggggatgttattacaagctgatcaaaaagctttccgacgtggagcagatcgagcagtttaccggcttcggcctctatgacgccaaatttatccaggttctgcgaggactgaatgatcccacgccgtttttgcgcggaattgtggcggagctgggctttaagcgcaaggaaataccctacgagcagcccctgcgccgggccggcaagaccagcaacaatttctaccgcctgtacgacgcggcgatgctgagtatcacttcctacaccaaggtagggctgcggctggctaccattttcggcagcatctgcgccgggctcagcatggtggtggccctcgtctacctggtgatgaagctgatctggtgggaccgttttccggccggcatggcgcccatgctgatcgggatgctgtttcttgggtcgattcagattttcttcattggcctgcttggggagtatattatgagcatcaaccagcgggtgatgaaacggcctctggtgatcgaggaagagcggctgaattttggcggggatgagaagtccggggcgcggcagatacaggatggtgagtaaacgatgaaatataaagttgatgtggtccggatccgggaaaattccattaccttaaacggctgggtgatcggcaaatccccggagagcaaggcgacgttccgtgtggaggacgagcggcacaacccggtgaaatttaagtatgtccccaccagacgggacgatgtgagccagatttattataaaaaatgttatgacagggacttcgggtttgatatccggtttccctatgagcgcggaaaaaactatttcctgctgatccgctgcgaggggaagcaggcgaagatcaaatataatgaggagctggtcgccaggcgttccagcgtggcccacaagcgcatcgagaaacttaaagatctgatgaacatggaaacggtccatgtggctatggatttctggaaggaacacggcctgaaggccctggtggtcaagtccaaacacaagcttcaggggctggacaacgactatgattacggggagtggtacgagctgaccaaacccacggaggaggagctggaggcccagaggaagaaattgttcgattttgagcccaggctgtccatcgccattccggcttacaagacgccggagcggtatttgaaggagatgctggactccatcctggcccagacgtataccaactgggaggtttgcatcgccgacggcagccccaagggcgagagcctggagcgggtgctgcgcaggtacgcggagaaggattcacggattcgttaccagattttgggtgaaaataaggggatcgcgggaaataccaacgcggccatggatatggcgcggggggattttctggtgcttgcggaccacgacgatacgcttccgcctcatgcgctgtatgaggtggtgaaggcgattaacgagcggcccaatgcacaggtgatttattcggacgaggacaagctggacatggacgggaaggcgctgttcgacccgcatttcaagccggatttcaacccggatcttttgaccagcgtgaattatatctgccatttgtttgtggtgcggatggatctgctggaaacggtgggaaggttccggcaggagtttgatggggctcaggactatgatttcattttccggtgcacggaggcggcgaaggaggtttaccatattcccaaggtgctgtaccactggcgctgccatcagaattccacggccagcaacccggagagcaagcggtatgcctttgaggcaggggccagagccattatggcacactatgagcgcatgggaatcgaggcggagtccgtggtgaagggtgtggactttgggatttatcgcacgaagtttaagattcagggggagccgctggtgtcggtggtgattcccaataaggatcactggcaggatctggatgtctgcgtgaagtcgctgatggagcgggcgacttatcagaatctggaatttgtgattgtggagaataatagcacggaggcggaaacctttgcgtattatgagcggcttcaggcggagcacgggaatgtgcgggtggtgacctgggagcgggagtttaattactcggccattaataattttggggccgggtttgcaacgggcgagtatctgctgctgttaaataatgatacggagattattgagccggattgtattcaggaaatgttgggtttttgccagcgcgaggacgttgggatcgtgggcgcaagactgctgtacgcggacgatacgatccagcacgcgggcgtggtggtcgggttcgggggaattgccggacacacgtttatcgggctgcataaggcggagaacagctattttcaccgggcgatgtgcgcccaggattacagcgcggtgacggcggcctgcatgatgacgaaaaagtcagtgttcgatcaggtgggcgggctttcggaggagttggccgtggcgtttaatgatatcgactattgcatgaaggtgcgcagtttggggaaactggtggtgtatgcgccgtatgcgctgctgtatcattatgagtccaagtccagagggctggaggatacgccggagaagatcgagcggtttaaccgggaggtggcggtttttattaagaagtggccggatatcattcaaaatggagatccgtattataatccgaatctgacgctgcgcaagtctaatttcgcgctgcgggatctgctgaaggagaaaatcggggagccctatgatctgagcgtgtatgaccggtttgcgccggaggaacaggcatgaagcggacgatggtgacggttgtgataccgaattataacggactgcagttcatggaggattgcttcgcggcgctggatttacaggtgtaccggcattttaaggtgctggtggtggacaacgggtctacggacggcagcgtggaatggctgaaggagcgcggtgttcccacgatttttctggagaagaatacgggattttccggggcggtgaatgtggggatcaaggcggcggatacgccttatgtgatcctgttaaataatgacacggagccggagccggattatgtgggggaattggtgagagccatcggaaggtcggaacggattttttcggtgagtcctaagatggtgcagatgtttaaccgggagctgatggacgacgcgggggatatgtactgcgtgctgggatgggcgtttcagagaggcgtggggaggtcggcgaggaagtataaccgggcctgcagggtgttttcggcgtgcgcgggggcgggaatttaccggaaatgcgtgtttgaggagattgggtattttgatgagatgcattttgcatatctggaggatatggatgtgggataccgggcgaagctggccgggtatgacaatgtgtattgtccggatgcggtggtgtatcatgtggggagcgggaccagcgggtctaagtataatgagtttaaggtgaggctggccgcaaggaataatgtgtatttgaattataagaatatgccggactggcagctggcgctgaatgcagtgccgctggcagtggggatttgggtgaagtatgggttttttaagcggttggggtttgggaaggtttattgggatggggtgaaggaaggaattgagagtagggggaagtgtaagagggtggattttcggaaggtgaagaatggggcctgctggagagctcagggggagatggcggcgggaatgatggtgtatttgtgggagtttgggtggagacaggtggggaagattagggggaagtgagagtgattctggcggggaagggattggcgggagctggaaatgaggtgctggcgggagagggtccgccgggaagcctggggccgcgcgcggccccaggctttgtggctgtcgccacacagggaaccttagaaaagtgcccgggaacgtgcgagcacgctcccggaccctttcctaaggccccctgcccggctcgtagacggaaaaaattaagatattttttatagtcaagccttgacagatcatgtataatatacaggatattcggagttttttgagcggattttgcggcggcgggggttggccgggaattagggtgagatgagatagaatgattaaggataatcaaaagacattgaaccggctgcatgtggtgctggacgcgctgtttattgtggtgacgtacagcctggtgtggctgattatgatcagcggtaaggtgctgcctgtgacggagggcgttgtcccggcgcagtattatttcgcagcgctgctttttattgttccggtgtatctgctgctgtacggcggatttcacctgtatgcgccgaaacgggtccagggacggcgcctggagtttgctaatatctgtaaggccaatattatcggcctgatgctgattacatttgtgctgtttgcagcgcgtaagaacggctacctgtaccatttttccacaagaatgattttggcgttctttgcgctgaatattgtgatgcaggccctggagcggaatgcgatccgcctgttcctgcgttccatgcgctccaacggctttaatctgaaacacattctgctgatcggctacagccgggcggcggaagggttcgtggaccgggtctgcgtgaacccggagtggggatatcagatccgggggattttggacgaccatcagccggcggggtatgcctacaagggagtggaggtcctgggaccgattgctaacctggaggtgtttttggcttccaatacgctggatgagatcgcgatcaccctcagcatcaaggaatatatgaatctggaggagattgtggccgcctgcgagaagtcgggggttcacaccaaatttattccggattacaataatatgataccgaccataccgtttatggaggacctgcagggccttccgattatccatatccgccatgtgccgctgaccaatatgttcaacgccaccatgaagcggctggtggatattgcgggggctgtgtttggtctggttattttttcgcccattatgctgcttacggccctgctggtcaaggtgacttctccgggaccggtgctgtacagccaggaacgggtgggattgcacaaccatacgtttaaaatgtataaattccgttccatggaggtccaggatcctaaaaaggagcggagtcagtggacgactccccatgatcccagagtgactcccatcgggaagtttatccgtaagacaagcatcgatgagatgccgcagtttttcaacattctggtcggggacatgagcctggtggggccaaggccggagcggccgctgtttgtggagaagtttaaggaagaaattccgcgctatatgatcaagcaccaggtgcggccgggactgaccggctgggcgcaggttaacggctaccggggggatacctcgattacgaagcggattgaacacgacctttattatatcgaaaactggagcctggggtttgatttcaagattatgtttttaacgatctttaaaggctttatcaataaaaacgcatattaattgtatgggaaaacacatactattgatacccaagtggtgtgcgcgactggaagatggtgcacgcgcaatggaatgaggatgacgcatgaatcgtgagtttgagagtggaaatggatttgatcaggaggagatgaacggcgcaaggcagagccgccgcaggcaggcggcgggccggcaggcggatcacgctgccgcgggcaggccggcgggcatggagcgcgcggcgaggccggcggctggcggggattcggccggccgtacatccgggaccgatagaacggcgggccgggcggagtatggtgcgggagaagctggcgcagccagacgtccggcgggagacgcggccagaaggagaccggcggacgcggccggggcaaggccggacgccgcccgttcaagacgtgcggatgcaggggctgcgggcggttacgccggcggccgtgttgcgcttcagggagcggctggtcggactatggcggctgccagcgccgatggcaggagcggagccaatgggcttggaaccggaggccggactgcggccggagctgcgggggcgggaagccgcgctgccggagctgccgcgccgtccggaagcagaggccagatggcgggcggaagcgccggagttggagcgagaggccagatagcgggcggaagcgctgttgccggagcgagaggccaggcagtaggcggaagcgccggggccggagcgagaagccagatggcgggcggaagcgctgttgccggagcgagaagccaggcagcaaacggaagcaccgctgccggagcgagaagccaggcagcaaacggaagcaccgccgccggagcgaaaactcaggcagcgggcagaaccgccgccgctggcgctagaacccaggcagcaggtggaaccgccgccggaccaagaacccagtcccctaacggaaccacagccggttcaagaccccagacgtccggcgcagccgcaaccggcgcccggcgcgccgggcagcccggcaatgttccgggaaccgctgcggcaggcagacagggcgcagccgcggggcagcgcgctgccggaggagatcgcccgcgctttaaaggtgagacgggcggggcgcctggcgccagagcggccggaaacggaaccgacggctggattgatctggatgagagcggccggaagacggaccgcaagggcggcggctccggaaacggaggcagccgcggaaccggcgggaccggcggaggccggggaaacggcgggggaagcggcaagcagagctcagagaaccgctattggcgcaaagtgatgatcggcgtgatcgtggcggagctgctgttcctggcattactgttcctggtgatcgtgcccgtcaaaaagaaactgaactcgattcagcgcaaccccaacatcaatatggcggagatgacgaacccgaacctgtcctacgagaaagtggagagcatgaaggggttttggaccgtggcgctgttcggcgtggatagccgtaacaattccctgggtaagggaaataacgcggacgtaaacattatctgcaacataaatcaggattcgggcgagatcaaactggtcagcgtgttccgcgattcgtatctgaacatagatgaggaaggaagctataataagatcaaccaggcgtatttcaagggtggcccggatcaggccgtcaaggcgctgaaccggaacctggatctggagattgacgattatgccgtgttcaactggaaggctgttatcgacgccatcaacatcctgggcggtgtggacatcgagctgagcaaggcggagttctactacatcaatgcatttatcacagagacggtgcaggccaccggagtcggctccgtacagctgacccacgcgggtatgaatcatatggacggtgttcaggcggtggcttatgccagactgagaaagatggacacggactttgccagaacggagcgccagagaaaggttattcagctggcctttgataagctgaaaaaagcggattttgcggttgtgaacaacgttatggaggttgtgctgggccagatcgagagcagcgtggacttaaacgatctgattcccctggcgaaaaccgtgaccaaattctatatcggggagaccacaggctttccccaggccagaggcgacctcaacatgggtaaaaagggcgactgcgtgattccgcagactctggagagcaatgtggtgctactgcaccagttcctgttcggggataataattacgagcccagtgacatggtcaaaaagatcagttccaagatcgcggcggactcgggactttataaagaaggcaagcccatagaccacgtgggtacggacggcggatatatccccaaaccgacacaagcgcccaaggcaacaacggctgcggaaacggaagaggaggacgaggagaagaccaccgcgtttgagacggaacccggtattatcgacggtgaatttccggacggcctggagctggagacagacgaattcggcaatgtcatcgacccgccggaggacgaagatccgctgtatccgggcggaaccggcacttatccgggaggcggaacctacccgggaggcggaaccggcgggtatccgggcagtggaaccggcgggtatccgggcagcggaaccggcgggtatccgggcagtggaaccgacgggtatccgggcagcggaaccggcgggtatccgggcggtggaaccagcgcatatccgggtgacggaaccaacgggtatccgggtcagaccaggccgtcacagccgggcagcgacaggcccacgtcttccagcacggcggcttatccgggggcaggggcaacaacctctccggacgatgtatccggccctggagcgacgacggcacccacaaggtctccgtacaacaataaccccactgtaccttcaaccaccagggcggcagaatccacggaaaacaacagcccgggaggtcccggatcagtgattttgggcccgggcgggaacggttgaaccgttgaatcgaatacagaaccacatgccacagggcgccagcgaaagctggcgccctgtttggccgtggactcagaaatatccgggatttgctcagaggcacgaaagccttctggagagaaatgcgataaactgctgctcgcgcaggttcagctcgtagagctgggacttgatcagacagattgccaccggctcgccgtccgccaggggtttgctgacgcagtccatgatttccaggttgccaggatgcatgagtccggctaacaggtaaccgcccttgcagaccgcgtcgtaggatgtgccccggtccgacacatagagggtattttgccgcccgtccgacaggctgagacggtcgtcggtgtccagattgacgtccattacagtggggtaacagctcaagtccgccttggttacctggatcgcgccggccagagggtgggagcgggacatatacacatgcatgggaatatcctgtttcattacggtgaaatccagcttgtaatcgctggcaagctggatgtatttggggagctggctttccagcatcatcaagattccgatccggcagcgccggttcacgataccggtcatggtttccttcagcccgctctccagaaaggtgtcgctgcacttggcgggatggagttgtttataatccagaaagtattggaaaatgttggaggacggggtgcagcagatggttagcgtgtttctgtcccggaaaatgtcgggcacgtccagaatgctatcccagttttttacaattttttcggcattttccaaaaaataccgtccctcgtcggtggcggtcaggccggagggcgtgcggatgaacacggcatagccgatctcgctctccacgtttttgatgatactgctcaagtgtgattgggaaatgtagacattctgcgccgctttgttgatggagcggcatttgtaagcttccaatatgtacgccaggtttttgatatccataagattctccgttgtcccccgcttatctgtatttgagataacctatccacgatccgtattagtaaaaccgtccggcatatgctaagattgattataacataacaaaatccgggccggcaagggaattcaaacgcaagggaagcttccttctgcagaggaagcctgccaaacataggagggtaacaaatgagtaaaaatgtagctgttgctgctgcgcgggatgaaaaaaaatcccgcgtggacagaatactggactccatcgagcgcgctgggaacgcgttgccccatccgttcattctgtttatgatcctgtccggtattatacttgtgctgtcgcttgtcatgtcccgggccggggtctccgtgaccgccctgtccgccaccaacgggggcagcgagactgctgagacggtgtttaccattcaaaacctggtgaccaaagactatctgttaaacctggtcatcaatttcccgcagacctttatctccttcggcccgttaaagaccgctttggtggtgatcatcagcatcgcggtggcggagcgttccggcctgttgtccgcgtttgtgcgccgggttctgctgggggcctcgcccacctggatgatgctcattatcgcctttatcgcggtcaacggtaatcttctggcggacgtggccgttgtggtgctgccgccgctctccggcgcgattttcgccgccatgggctttaacccctggctgggaatcaccctctcctacatcggagcaacggctgccaattcagccagcattgtgatcaccagcacggacatcaacctggccgccgtgacccagcagatcaccgggaacctggggatcaacgccccggtcaatccgctgatgaactggtattttatcatggccagcacgttcgtcatcacgatcaccatggtggtggtcagcaaaaccatcatgaagaacaagcttccgctgcgggacccaaacgccaatttgaccggcggggggagcacgctgatctcagacagtcagctgacgccggccgagctgaagggcctgcgggccgcggggattttttcgctggtttatttcgcccttctggccgttatgaccattccgtccggtggcattctccggtctccggagggcacgattctgcccgcgtcgccgtttttgaacggtctggtgatgatcataaccctgtacttcattttcgccggtatcatttacggcaaggtgtcgggaggcctgaaaagccttcaggacctgccggatatgatggcgaaaggaatcacggatgtgtccgggttcatcgtcatcatcctcagcgccagcatcatgattcaggtgttctcggacagccacatcggcgatatgatcggcgctgccggcggacagttcctcaaagactttaacatcgggcccaccgccgcgctggtggggctgattctgatcaccatgttttccaacctgtttgtgatcagcgggctgaccaaatggcttctgttcgctccggtattcatcccgctgttcgcctccatcggagtgtctcctgcggtgatccagatgacctaccggatcggcgacgccatcaccaactcgatctgtcccatgaacgccatgctgggcgcaattatcggttattatacgctctggaagccaaagggatatggtaaggtgggcctgggaaccattatggttctggctctgccctacacgatggccatcgccgtggtgctgatcttgcagtttctggtctggatgctgtttgggcttcctctgggaccaggcgccggtgcttttatgtaaataattattgctgtgaaatggaggaatctatgtctttcaaaaataataccatcattgagacgcgcgtacttgaggtccgggagcttggggggccgggaaaacggcgatggagggaaattctggtggaatacccggagatttcattcgggcccggacagtttgtcatgatccgaaaggattgcggcccgacctgctgggcttatccctacatgctccagagaagcacggaccggggatttacggtctgcgcagcagagaattcatccctgtatgaggcggaggccggtaccccgctggtggtctggggagccaatggccgcgcggtgcggccgggcgtggatacagtagttctgtcccagtccgccacattgtttctcgccgcgccgtttctggaagcggagccccggtgcaggcagattgtgctgtgcgatccgacggacaggaattttctggaaagtagtccgtccatactcccggtggaatcggtggaggagatggcgcgggagttggaactggcccggcccggcgctgtggtggctgcgctcaacgtctccgtcctgctggagcttgcggctgcatggaaccggccccaaaatctgccctttgacgtgtttgccgccaccaagatcagctgcggggtgggcggatgcaagagctgttacctgcacagccggtccatccggctgggaatacccgtgtgctgcagcggtccctacctgccttttgagcgggtggactttgagacggactgccgctgttttcacacatttgaatagacagggggaacgatatggctgatttaacagtccgcattcccgtaggaaaacgggaactatgttttaaaaatccgatcatgccggccgccgccgggctgggcgatctgatcgaatacggaaaatactatgatttgagcctccttggcgcgctgatgcccaattccatcatgatggagagtggatcagtctccagagccaggaagctctacggcgcggagtacggctacatcacctccctgggcagcaacagcctgggcgtgatggaatatgtgaaaaaaatcgccgtgcatttgccctggcgagaagccccgctgattttgaacctgaaggccgaggatttggaggggctggtgcggctggccggtaccgcggctggctgccgggaggtggcgggaattgagattaatatgaactgtccgtactccatggcggccacggacccgcgccagtattggcgggattacgggtggctgcgggaaatgatccggggtgttcgggaggccgctggtgagaagcttttaataatcaaggtgcccaccactatggtggatgtggaggacatcgccgccattgtcaaggaatgcggggcggacggctttacctcttttggggcgctgaccggctgtgccatcgacgtgcgcgcccgtaaattccgctgcggaaacagcggcagcggcggctactgcggtccgggactcaaacccctggctctgtggagctgcagccgggttcacaaggccgtggacattcctattttcagcgccggaggcgtgacgaacgccgacgatgtgatcgagcacatcatggccggcgcctggatggtgcaggtgggttccgccaatctgaccagaccggatttcatgccccgtctgatcgaatccctggatcggcgtctggatgagctgggaatccgctctctggatgagatacggggctgtgtaaaaccgcattaaccgtttttttaggaccgctgcccggtttgccggagcagcggtttcaatattttagggtttcctaataaaaatgtcacaattttatcacatttcactgataaacttaatcccataatcggaacatatgagaacgttcagagagaggggtgcgtgttttgtacgagaatggacagcagtatgaaaatggaatgaattacagccagggcccgcagcagggcccgggttcttacaataacccagggagcggagcgccgcggccgggcgggccttccaggccgccccgcaggaagaaggggggagcggtcaagagagtggccggcctgatcgccggcgcaatcctgttcggcggtgtgtcgggcgccaccatggtgggcgtgaatctggcggccgccagttttctgccccaggccgtgtccgcgcccgagggaactgcgagcacggatgaacagaaggcccaggagacccagacgcccggccaggacaacgggaatattgagaatatccagcctccggcggggaagttttatggcaacggcggaggcccctacaactccggcggggtggacgtgtcctccatcgtggaggaggctatgccctctgtggtggcgatcaccagcctgatggagtatcagagtaatgatccctactcctggtttttcggaggcggcggaacgcagacttacgaggtgcccagcagcggctccggcatcatcgtgggggagaatgacaaggaactgctgattgtgaccaataaccatgtggtggcggactccaaggagcttaaggtggcgttcatcgacgacgaggtggtggaagcggttgtcaagggcacggattccgactcggatctggctgtcattgcggtgtcgctggaaaatattccggaggagacgcaaagcaaggtccgggtggcgaagcttggagattccgacgccctcaaagtggggcagggcgtgatcgccatcggcaacgccctgggttacggccagtcggtgaccgtaggctatgtgagcgcgctgaaccgcgaggtgcgcacctcggagaacaacaccaggacgcttttgcagacggatgcggctatcaaccccggcaacagcggcggcgcactggtaaacatgaagggcgaggtggtcggtatcaacgcggccaagtacgcctccactgaggtggagggcatcggttatgcgattcccatttccaaggctgagggtatcatcggcgatctgatgaacaaaaagactcagacccaggtggccgaggagaaaaggggatatctgggaattcaggggattgccgtggactcggataccgcaaaggctttagggatgcccgagggcgtgtatatttacaagatactggaggatggggctgcggccggctccgggctgtttgagaaggatattatcaccaagtttgacggccagtcggtgaaaaccatggcggatttgcaggaggtcctcgcctcctatgaggtaggagagacggtgaacctgacggtgcagtcgctgcaggacggacagtatgtggagcacaaggtgccggtcaccctggctccaatgccggcgaatgagccgtaggaccgctccatttattgaaaatgcttcctcttgttaggggaggcattttgttatatactaagaggaacggagactctatttttgagaagcagagaggagaaatactttgggagagagcgataagaaccaggatgagataaaggaaaatcccgccggtccggaggacaaggaccaggcgcgggatgacgatcaatatgagaaggtgtgttacatatgccgcaggccggagagcaaagcgggaaccatgatctccatgcccgggggcatgaatctctgccacgactgcatgcagaaggcatttgacacggtgaccaagagcggaatggacctttccaagctgcccgggatgccgtatatgaatatgaatctcaacgagatgaatttaaaccagcccggtatggagatacccaagaagcagaagatccgcaagaaagcggacaaacagccggcgctgtccatgaaggatatcccggcgccgcaccagatcaaggcccggctggacgagtacgtggtggggcaggagaaggccaagaaggtagtctccgtggccgtttacaaccactacaagcgcgcgttcctgggcgggaagcctgaggaggagaccgtctccgggccggacgaggaagtgaccattgagaaatccaatattctgatgatcggccccacgggcagcggcaagacgtacctggtgaaaaccctggcccggctgctggacgtgcccctggccatcgcagacgccacctccctgacggaggcggggtatatcggagacgatatcgagagcgtggtcagcaagctgctggccgctgcggacaacgatgtggcgcgcgctgaaaagggcatcattttcatcgacgagatcgacaagatcgccaagaagaagcagaccaacacccgggatgtcagcggcgaatccgtgcagcaggagctgctcaagctgctggaaggcagcacggtggaggtgccggtggggtccaaccagaagaacgccatgacgcccatggccacggtgaatacggataatatcctgtttatctgtggcggcgcgtttcccgatctggaggagatcatcaaggagcggctgaccaaaaagtcctccatgggcttcggcgcggtgctgcgggacacctttgacaaggatcccaacctgcttagctacgtgaccaacgaggatctgcggacctttggcatgatcccggagttcctgggacgcctgcccatgacggtgacccttcaggggctggaccgggatatgatggtgcgtattctcagagagccgaagaacgccatcaccaagcagtacgagaagctgctggctatggacgaggtccggctggtatttgaagacgacgccctggactggatcgccggggaggccatcaagcgaggcacgggtgccagagcgctgcgggccattctggaggagttcatgctggacatcatgtatgagatccccaaggactccaacatcggttccgtggtggtcacccgcccgtacctggagaagagcggcgggccactgatccggatgcgcggctgacattgccctgctgacactcgaacgtttatattcgaacgtttatattcgtaagtttgtacccgtacgtttgtatctgtaatttttttccgcagatttattcccgcagatgaagaaatgtctggaacagatccagcgcgccatacccccactcgcggttggggtaggacagcgctggatttcgttttgctccccggaccaggtaggagcggatggccgcctcgctcatggagcggtcgtttccctccacaaacccccagctcatcaggttggccaccgctccggcggcgtgggcggcggccacggaggtgccggtgcggcgcgtcatgggcacggtgtccggggggccggtgagggcggggccgtacacatccacgccgggagccgccagatccggcttgatcacgttggtgagggtgtaaccgcggctggagtggatgtagatgctgttgttgagatggttgtaggctccgatggtcaggggcgacggagagtttccgggcagcgtgatggtgttgttggggctgggattgagaaacaccgtctggtcggagatgaagctctccacgggcagccacatgtgatagctcccggtgaaaaactgggagttgtagacccggatgcgccagatgcccacggtgggttcttcgaaccgcatgaagatcagctggcggccggtgagggcctcgatcagctggtaattgacggtgatcaccgtatcctccaacagaaaggggatgcgggtctcattgccggaaatgatggggatccggctgatggcctcgccggtgggggagacgaagcccacggagtaggtgtccgagttggtggcccacagctccagcacgaatccacggcgggattcctcctcccccacgcggatttccacatcctggtaaggctcgtcggaggggataatgccctcgaagtgatgggacaggccggtctcatttcccgcggcaatcacggcggaaaagcccaggaagcgggttacgtcctggattgaggtgcttaagggcgagagcccctcgtggcttcccatgttggagcccagggcgatgaggatgaccaggggcatgcggtagcggtgcgccatgacccgcaggtatttaatgcccatcatgatgtcgttttcctgaaatgcggtggcgccttcccggatcagatagtagtcccggaggtagcgcttggcctgcttcagtttgaccaccaccaggctgcactccggggccgctccggtgaaggagtcgtccggcagcgtccccccggcggcgatccccgcgataaaggtgccgtggccgttggtatcccgggagggaaccagggacagcggatcgtcggaggccagggcttcattgatctgttcttcggtgaattcagtgccgtaggacgctccgctcatgggaaaataatccggcacgccggggggaagctcatccgtgtcctccggtagggtctgatcccagattcccagtatccgcgtggtgccgttgggattgcggaacagacggttggtgtagtcgatgccggtatccagaaagccgatcatggtgcccgcgcccttgtttgccagagccggtgtgttgaaggtggagagaatgccggaggcatccatgctggaggtgtccaggggggtgaacagattagggatactgtagtaagcatacttctccagagaaaggggaaggatgctgtttagggggacgtaaaagatcgcgtagttttgcgtgacgaattccgtgcaggccccggagagcagagggccggtgggggagagcacattctggctgctgtagttatagatgaaatccgcgtagtcctcggaagccgggttaaagggacagagtgccataaattgcctcgcagtccgggcgtttctactattatatgcgaaattttagaaacgtttcactggacggtgggtggagaacatagtaaaataatggtagtggttttgcgagcctggggatttgaggaaaagggtgaaggtttcgggcaggctaaggtgcggatttttgctggtgattgtggggagtccggacagttacgaaaatataggttggatttgaatgggaaaaggaggcggagcgatgtacggttggctgattggaggattgacggctctggatttggggattaaacaggtgattgaggatcagggggatgagacgtttccccgggatctgccctgcgcgaaggggtggatcaggctgtataagaatcataacagcggtttcccgtttggggtgcttaagcagaggccggagcttgtgaaggggattccgctgatggtagtgtccgcgctggtggggggactggtggcgctgatggaacggaaggattcggcggtggaacggattgggctggcggtgaccattgggggagcgctgagcaatctgtatgaccggatttttagagggtatgtggtggattattttagtgtgcagtggaagggactgaagaaggtggtgtttaatctcggggatatgtttattttcctgggggcgatgatgattgcgggggcgcaggtggtgaagagtttgaggggggaataaggaggatacggagttcctgggcggtggcttgggggctctttttttgagtgcgcggggggacgcgggggtacgcgccggaacggggcgcaaacggatgagcgcgcaggggtggaaaacgaagcgcaggggctaaagcccggggagggagaaaagcagggcaccggctctattcgcggagaaatcctgaaggctttctccgctcaggtcgcctgaaatcgtgttttggagaacacgatttctccctgcttttctccctccccggacttaagcccccgcggtccgtattccaatccccctgcacactcatccgtttgcaccccgctccggcgctgggaccgggcgggggagatggggggtgcgcgatggttttttgagggagagcggtattttgcgtggagacgggagttgcagtgtgtttggggttagcttagcatgccgcccagggtgccgccggcggcgcagagggccatgacggtgagggagcggtggatgtcgatggcggagccgcggttcatgagccaggatacggcgaagaggaccaggaagtagagcaggccggacaggaggccccagaagaagcggcgctggcggatgcctttgccggcggtgaggccgccaaggaggcaggtgatgaagtagatcgcgtagaccatgatgtttacctgtccctctttcaggcgcagctggtagagggcgaaggccagcacggccaggaggatgccgctgagcacgtaggagaccagcagggagcaaagcatgggtttggcaattccgttttccatttatttttctccttttacagttcttatggtccaatatattccccgggattgcgggatattcgcaatttcccgttgcatgggccgcgatcctgtgttataatttcatggaattatattttggagtgaaaagaggaggtgtcgctatgaagcgcgttaaaactttaaatgccaataccctgaaggataccatgaagaagggcggatgtggcgagtgccagacttcctgccagtccgcatgcaagacctcttgcaccgttggcaaccagagctgcgagaatgcaaaccgctaacatgtactgaatgtgattggtacaggattttgattggtcaaagcccctgtggtccgccggattatgggggttttctcatgtgtgtgagcgttgtcggaacgcttcggaaagagagagtgtatttgtgattcatcaatttttgaataatggttatcatatcgtgctggatgtgaacagcggttccgtgcatgtggtggacccggtggtctacgacgcggtggcggtggtttcggagctggtgccggagctggatcagccggagaagctggcggatgaggtcaaggtcgaggtgagaagccggctggccgggcgttatcccctggacgatgtggaggaggccctggaggatattcaggagctgatcgatctggaacagcttttgaccagggatatttataaggattttgtaatggattttaagcggcgtaagactgtggtcaaggcgctgtgcctgcatatcgcccacgactgcaacctggcctgcaagtattgctttgcggaggaaggggagtaccacgggcggcgggctctgatgagttacgaggtgggcaaaaaggccctggatttcctgatcgccaattcgggcagcagggagcatctggaggtggacttcttcgggggcgagccgctgatgaactgggatgtggtgaagcgcctggtggagtacgggcgctctaaggaggcggagttccacaagaagttccgtttcaccctgaccaccaacggcgtgctgctgaacgacgaggtgatggagttctgcaaccgggagatgagcaatgtggtgctgagcctggacggacgtccggaggtcaacgacaagatgcgccccttccgcaacggcaagggcagctatgagctgatcgtgcccaagttccagaagttcgccgagctgagggatcagaataattattatgtgcgcgggacctttacccgccacaatctggattttgcggcggatgtgctgcactacgcggacctgggcttcaagcagatgtccatggagccggtggtggctccgccggaggaggattatgccatccgtgaggaggatattccccagattctggaagaatatgacaagcttgcattggagtacatcaagcgcaagaaagaggggagagggttcaatttcttccactttatgctggatctgaatgccggtccctgtgtggccaagcgtctggcgggctgcggctccggcaccgagtacctggccgtgacgccctggggcgatttatacccctgccaccagtttgtgggaaatgaaaagttcctgctgggaaatgtggacaccggcgttgtgaacacggagatccgggacgagttcaagatgtgcaatgtgtacgcaaaggataaatgtaaggactgtttcgcccgcttctattgcagcggcggctgcgcggcgaacgcttacaatttcagtgattcaatcaccggcgcttacgagatcggctgcgagatgcagaagaagcggatcgagtgcgccatcatgatcaaggccgccctggcggacgaagaggcgtgagatctatggaatataaagtgataacaaaggacggccgggccaagcgggcggagatgaaaaccgtccacggcaccatccagaccccggtgttcatgaacgtggggacggtgggggccatcaagggcgcggtttccaccgacgacctgcgccagatcggcacccaagtggagctttccaatacctaccatctgcatgtgcgcaccggcgacaaactgatccgggagttcggcggcctgcacaggttcatgaattgggacaggcctatcctgacggactccgggggctttcaggtgttttccctgaccagtctgagaaagatcaaggaggaaggggtctattttaactcccatatcgacggccgcaagatttttatggggccggaggagagcatgcagatccagtccaacctgggttcaaccatcgccatggcctttgacgaatgcccgcccagccatgcggacgagcagtacatccgcaattccgtggagcggaccacccggtggcttgcccgctgcaaggaggagatggaccggctcaacgctctgccggacaccatcaaccgggaacagctgctctttggcatcaatcagggcggtgtggtggacggcatccgcacctggcacgcggacgtgatccgggaaatggacctggacggctacgcggtgggcggcctggcggtgggcgagagccacgaggaaatgtaccacgtgctggacgtgaccgtgccccatctgccggaggaaaagccggtgtacctcatgggcgtgggaactcccgccaatatcctggaggcggtggatcgcggcgtggacttcttcgactgcgtttacccgtcccggaacggacggcacggccatgtgtacaccaaccatggaaagctcaatctgttcaaccggaaatacgagctggatgcccgccccatcgaggagggctgcggctgcccggcctgcagatcctacagcagggcgtatatccgccatctgctcaaggcaaaagaaatgcttggaatgcgattatgcaccttgcataatttgtatttttataatacaatgatggaagagattcgcgacgccatcgaggaacaccgctatgccgactataagatgaggaagctagccggtatggaagggtctcaggaatagcaatcgcccgccagaaggcggcggcccattgcactcagcaatcgcccgcccaaacggcggtctgttgcatttattataagctaccgcggcgaggcggcggtaggttcgtgaaggaggaaacaagcgatgacaaacagtccgattttctgggttctctatgtggttctgctgctgggaatgctgtattttatggcgatccgtccgcagaagaaggagaagcagagacagcaggagctgttgaacagcgttgcagtaggggataccatactgacatccagcggcttttacggtgtgattatcgatatgaccgatgacaccgtgatcgtagagttcggcaacaacaaaaactgtcggattcccatgcagaaagctgcgatcgtccaggttgagaagcctgaagcgtaagcgatgagagagcctgaggaccggacaagtatccggctcccgggcttttatcttttgtaatggttagacggcgggaaaggtctgcaccattacatatcttttcaggaaggtggagaataaaatgattcggaacattgtatttgacatgggcggcgtgctggtggagtatcagccggatcgggtagtccggaaatttgtggaggacgaggcagaacgccgggcggtctgcaccagcgtgttcgtgtcgccggagtggatcatgctggacatgggcgtgatctcggaggaagcggcgcttgaacgtatgcaggcccgcctggacacggatcacgccagggagatggcggcgaaatgcttggctcactggcatgaatacaacatgtggcccaaggagggagcgggagatctggtccgctggctcaaggatcagggctacggcatctacctgtgctccaacgcctcgctgcggcttctggactgctaccgcgacgtgattccggggatcgagctgttcgacggcgtgttcttctcagcggaggagaagtgcatgaaaccccagaaggaaatgtacgcccatctgtttgaacggtttaacctgaaacccgaggagtgcttcttcgtggacgatctccagaacaacatcgacggcgccagggccgtgggcatggacggctactgcctggcggacggcgacttgaaaaagctgtttgaacacttgaaaacgcttcaataacggatagaaaaagctccatacctttcggcatggagctgttttcttaggattttcggattttcaaaaagggttgaaggatagttgttattcgtgcatttattatgtttatagtatagcatgcatttcgcgggaatgtttgaatgttccttgaatagattattaagaaattcttaaattatcgtctgaagtcagaccgaaagtggtcaggaaacgttaaaggatctggaatttaacggaaaatttatgggtcaggctgccaaaaatgatttggcggtccacaacctctcccttgcggaaccagcggactgggaccggaatatgctaataaaaaagggagaaattataatgtgaatcaggcgagaaaagaaattcactgtgattcggtttatgagatggggatcacaggagccggagtcggcgttgcggtgctggacaccggaatttatccccatgaagattttggcaacagagtagtcgcatttaaggattacgttcatcatagagtcgggccatacgacgacaatggccacggaacccacattgccgccattattggcggcagtggtgtttcatcgggaggcgtttaccgcggggttgcccccggctgcagcctgattgccgtcaaggttctggacaataaaggaaatggattcgcctccgacgtgctggccgggctgggctggattcgggaacataaggaggaatacaatatacggatcgtcaatatctccgtgggctctctttcgcggagggatatgacggaaaattccgtgctggtgcgcggcgtggacgcggcctgggacgacggcctggtggtcgtggtggccgcaggcaaccacgggccgggccggatgaccatcaccacgccggggatcagccgcaaggtgatcacggtgggctgctcggacgactacaaggaagtggatgtgatgggcaaccggatggtggactattccggccgcggcccaaccctggcctgcgtgagcaagccggatatcgtggcgcccggctccggaatcgtcagctgctgcaaccaaccggcccgctacatgaccaaaagcggtaccagcatgtccacccctctggtctccggcgccatagcccttctgctggagcgatacccccacatgagcaacaaagacgtgaaaatgcgcctgatggagcgggctgtggacatgggaatgccccacaaccagcagggatgggggatgttggatgtggagcggttggtgctgtaaccgaaaagccgtttggtccggaaccttataataggcgacagagccaaacggctttttagtttacgcttcccaccgcccagcagccccacagggcagcaccaggccggtctgggtgacgggcaggccgatctcctcggcgcgcacggttccgccgtgggaggcggccacctccacgcccagcagataggagagcacggccggggccaggccggtggtgtaggagttgatcaggaagaacaggggctgatcggagagcagcctggcgcacagcctgaccagcggatggatggcatcctcgatcttccagatttcgcctttgggcccacggccgtaggagggcgggtccataatcacggcgtcgtagtggttcccacggcggatctcccgctccacgaatttaacgcagtcgtctacgatccagcggatgggcttgtccgccaggccggaggaggctgcgttctcctttgcccagcccaccattcccttggaggcgtccacgtgggtcacggccgctccggcctgcgccgccgccagggtggctccgccggtgtaggcgaagaggttcaacactttaacggggcggccggcctcgcggattttggagccgaaccagtcccagttggcggcctgctccgggaacagtccggtgtgcttaaagctgaagggcttcagattgaacgtgagccctttgtatccgatggtccactgctggggcagatcgaaaaattcccattcgccgccgcccttgctgctgcggtggtagtgtccgttcatctgcttccagcctttgtgggcccggggcgtgtcccagatcacctgggggtccggccggaccagcagataattaccccagcgctccagtttttcaccatttgaacaatcgattacctcataatccttccattgatctgcaagccacatacaatcgcttaacctcatttcttaaattgatttcttctatatcgtaagtttcatttaatatcagtcccataagtatagtccaaggatgcctgaaacgtcaagtattgtggatgttttcgtgaaaatacgaagattttacgcaacagattatgaattgggcaccgtccgggctatcttcctgaccgaaaaagccggtcaggaagcatcggatgtccatccgatggggaaaatggtacgaaaaacagcttacaagcgagcttgacgctgctttttgcaccatttttcccgccctataaacggttattcaaattgtaatagaattgaaagataaatattgttgcttaattgaaggtcccttgatacaatatatcataggattaccggatgccggcctggcggttttcaggcagcttcggtggagtgcaaatcgggaataggagttgagcttatgaagagaagaaccgtggcggtgtggatactggcactggtgttatcgctggggacagccaccttgtccgctatggccgcagagggatggaagcaggagagcaacggctgggtgtatctggattcccatggggaccgcgtgtacaatgcgtggaagaagggagccgacaacctctggcgctacctggacggcgacggcgtgatggcgaccaactgctgggtggacacggattactacgtggacggagacggtatcatgtataccgagaagtggctgaaggttaccaacgacgagggcgagtacgagtggtattacttcggcagcagcggcaaggccatcaaggatacctggaagaagatcaatgacaagtggtatcattttgacgacgacggcaagctggaagtcggatggattttggatgatatgtattactgcggtgaggacggagttatgcggacaggctggcagaagctgtatccgccggatggcgatgattacgacagcaaccgcgtaactcccagttttgacagtttggacgacgatgacgggcgaaactggtattacttctcatccagcggcaagaagtacgtgccggacgacgacagcggcgattacggggccaggaagatcgaggggacctactactgttttgatcaggacggcgccatgcagaccggctggaagaacgtgagatccggcagcagcgattccattgaggattacatgtacttcggttccgacggcaaggccaagatcggctggtattccatcgaacctccggaggacctggaaggctacgacggggatgtagagtggttctacttctccaacagcggaaagccgagagcggctgattcggacaggcttacggtcaatgatctctggaaggtcaacgggagaagctatctgttcaacaacaaaggcaacccggtacacggtttgcagaaggtatacaccggcggggacagctggaccgctttttattttggggataaaaacaccagcaatgttcaaaaagggaaaatgaagattaccgaaggggatggaagccgttcggatttttattttgctgataacggccgcggttacaccggcgtgaaggacaaccatctctactatgccggtaagcttcaggaggccacggacggatccaagtacatgtgctaccgcgtaaacggcaataactatgtggtcaactcctcaggcaagatcatgaagaacagcaatgtcaagaattccgacggcgtcaagttcaccaccagcagcagcggtacgctgcagaaggcggacgacgatacggatatcggcggatacgtcaacgatccggtggagccggtttgggatgaggattgacggtccccattatatatagaagaaacgcacccgccatttcgatggcgggtgttttgctgtccgtcgccgcatgtctgggaagaaattaaaagctgactcaaaaagcgtgccaaaaaaataaaaaaagacttgcatctaaaaaaaaagtgtgctatgataacaaggctgtggcatgatagctgtgaagcgtgaggttgctgaccacaaagtgggcaggttttccgtggagcgaatgtcaagttaggaaactggcgacaagtcactgtaccaattaaagaagctgcgaaaatgcaatgcaaggaacagcatcagtgtgtagtccttaggacacacacggaaacgtgtacagtcaccgcttgtcgtacttggtttaaaagtgcgaaaaggaggcgactttttttatggcaagtcaagtaatgagaatcacattgaaggcttatgatcatcagttagtagatcagtccgccagcaaaatcatcgagaccgtaaagaaaacaggatctcaggtgagcggaccggtgccgttacccaccaagaaagaggtagtaacgattctgcgtgcggttcataagtacaaagattccagagagcagttcgagcagagaactcacaagagactgatcgacatcatctccccgaatcagaaggctgtcgaggctctgtccagactggaaatgcccgctggcgtgtacatcgacatcaagatgaaaacgaaataatcggagattatcgagttttcagacaaacatgtttatatcctgaagggtttagatatagaagcaacactggcaattcctgttgggaatcaacataccgcaaggcggttcatagtgttccacgtatattagactgttctaggatgaatgcgaaagcattccgctgtagatcatgaaacaggaggtaagacaatgaagaaagcgattttagcaacaaaagtcggaatgacccagatcttcgatgagaatggcgtgttaattccggtaaccgtgcttcaggctggtccctgtgttgttacccaggtaaagacggttgacaacgacggttacaaagcagtacaggttggtttcgttgacaagcgcgacaagctggttaacaagccgcagaaaggccattttgacaaggccggcgtttcttacaagagatatgtgagagagctgagattagagaacgcggaagagtattccgtaaaagacgagattaaggctgacatcttcgcccagggcgacaagatcgacgctaccgctatttccaaaggtaaaggcttccagggcgctatcaagagatatggccagtccagaggacccatggctcacggttccaagttccaccgtcatcagggttccaacggctccgccaccactcccggccgcgtattcaagggcaaaggaatgcctggtcagatgggcaacaagcagattaccattcagaatctggaagttgtcaaggttgacactgagaacaacctgcttctgatcaagggtgctgttccgggaccgaagaagtctctggtaacaatcaaagaaaccgttaaggttgaacggtaagcttttataggaaaggaggaacacacagatggcaaacgtatctgtttacaatatggaaggcaaagaagttggcagcatggagctgaacgatgcagtgttcggtgttgaagtaaacgagcacctggtacatcttgcagtggttgcccagctggcgaacaagcgtcagggaactcagaaagccaagacccgttctgaggtatccggcggcggcagaaagccgtggagacagaaaggaaccggtcatgcaagacagggttcaaccagatctccgcagtggaagggcggcggcgtcgtattcgctcccgtaccgagagattacaccatcacgctgaacaagaaagagaagagggctgctctgagatccgctctgaccagccgtgttcagggaggcaagttcatcgttgtggatgagctgaagttcgacgagatcaagaccaagaagttccagaatgttatggataacctgaaagtaaacaaggctctggtagttctggccaacaacgatcagaacgctgtattatccgccagaaacattgcggacgtaaagaccacccaggttaacaccatgaacgtatacgacattctgaagtacagcacagtagttgccaccaaggctgctgttgcaaccatcgaggaggtgtacgcataatggcagacattaaatattatgacgtcattttgaagccggtgatcactgagaagagcatgaacgccatgactgacaagaagtacacattcatggtacatgtagacgccaacaaggcgatgatcaaagaagcggttgagaagatgttcccgggcaccaaggttgccagcgtgaacaccatgaactgcgaaggcaagaccaagagaagaggcatgacctacggcaagaccgctgcttccaagaaggcgatcgtgaaactgaccgaggacagcaaagagatcgagatcttccagggcctgtaatccggaagataccaacccaccgggtcatcccggtcggagaacttatacgacgcttttggatatgtcgtgaaaagaaatagaaaaggagttaaatgtcatgggaattaagaagtataatgcttatacaccttccagaagacatatgaccggttctgatttcaaggaaatcaccaagagcactcccgagaaagctctggtagtgtccctggacaagaacgctggtcgtaacaatcagggtaaaatcactgttcgccacagaggcggcggcagcagaagaaaatacagagtgatcgacttcaagagaaacagcaaggacggaattccggcaactgttatcggcattgagtacgatcccaacagaaccgctaacatcgcgctgatctgctatgtggacggaaccaagtcctacatcctggctccccagggcttaacggacggcatgaaggttatgagcggcgagaacgcagaggcaaaggttggcaactgcttaccgctggctaacatcccggttggtgcgcagatccacaacatcgagttatatcccggcaagggcggccagctggttcgttccgcaggcaatgcggctcagctgatggctaaggaaggcaagtacgccaccttacgtttaccgtccggtgaaatgagaatggttccgatcatctgccgcgctaccatcggcgtagttggcaatggcgaacactccctgatcaacattggtaaagctggaagaaagcgcaacatgggcttccgtcccaccgttcgcggttccgtaatgaaccccaatgaccatccccacggcggtggtgaaggtaagtgtggtatcggtcgtcccggtccctgcactccttggggcaaacctgctctgggcttaaagaccagaaagaaaaacaagcagtctaacaagttgatcgtaagaagacgcgatggcaaaaccatcaaatagttaaaggaggttaagaacacatggctcgttcactgaaaaaaggaccatttgcagatgcgcatctgttaaagaaagtagacgctatgaatgcagcaggacagaagcaggtaatcaagacctggtcccgccgttctacaatcttcccccagatggttggtcacacaatcgcagttcatgacggcagaaaacacgtgccggtatacgtcaccgaggatatggttggtcataagcttggtgagttcgtcgctaccagaacctacagaggccacggcaaagacgagaaaaagtccggagttagaaagtaattcgcaggtaagtttgaaaggaggttttaccaatggcaaaaggtcatagatcccaagtcaagagagagagaaatgcccagaaggatacaagacccagcgcaaaactgtcttacgctagagtatctgtccagaaggcttgtttcgtattagatgccatcagaggcaaagatgttcagacagcacttggtattgtaacttacaatcccagatatgcttccagcttaatcaagaaattactggagtcggcagtcgcaaacgctgagaacaacaacggcatgagcgccgagaacctgtatgtggaggagtgctacgccaaccagggcccgaccatgaagagagttagaccgagagcgcagggacgtgcttacagaatcgaaaagagaatgagccacatcactgttgttctgaatgagagataaaggaggcaaatatgggacagaaagttaatccacacggcttaagagtcggtgttattaaagactgggattccaagtggtatgcggaagctgacttcgcagactgtctggtagaagactataacatcagaaagttcctgaaaaagagattatacagcgccggcatttccaagatcgagatcgagcgcgcttccgacagagtgaaggtgatcatctacaccgcgaagccgggcgttgtaatcggcaagggcggcgctgagatcgagaagctgaagaaggaagttcagaagctgaccgacaagaagctgttcatcgatatcaaagagatcaagagaccggacaaagacgctcagctggttgcagaatccatcgcacagcagctggagaaccgtacttccttccgtcgcgccatgaagtccaccatgggcagaaccatgaagaccggcgttaagggaatcaagaccgctgttggcggacgtttaggcggagccgacatcgcgcgtaccgagttctacagcgagggcaccatcccgcttcagacattaagagcagatattgactatggtttcgctgaggcagatacgacctacggcaagcttggcgttaaggtttggatctacaaaggcgaggtacttcctactaaaggaaacaaggaagggagcgataaataatgttaatgcctaagagagttaagcgtcgtaaacagttccgtggatccatggccggcaaagcattaagaggcaataagatctccaacggtgagtacggtttagtcgctactgagccgtgctggatcaagtccaaccagatcgaggcggcccgtgttgccatgacccgttatatcaagcgtggcggccaggtttggatcaagattttcccggataagcccgtaacagcaaagcccgctgagacccgtatgggttccggtaaaggcgctctggagtactgggtagcagttgtaaagcccggccgtgtattatttgagattgctggcgtaccagaagaaacagcaagagaagctctgcgtcttgcaatgcataaactgccctgcaagtgcaaaatcgcttccaaggcagatttagaaggcggtgataacagtgaaaactaataaatttgtagaagagttaaaggcgaagtccgtaaaagagctgagcgacgagttagtagctgcgaagaaggaactgttcaacctgagattccagaatgcaaccaatcagttagataacacatccagaatcaaagacgtgcgcaaaaacattgccagaattcagactgttatcactgaaaaggcgaatgcttaatgaaaggagaacttaccgtggaaagaaatttaagaaagactcgtaccggtaaagtggtcagcaacaagatggacaaaaccgttgttgtggcgattgaagaccatgtaaaacatcctgtgatcggtaagattgttaaaaagaccgttaagttgaaagcgcatgacgagaaaaatgagtgcaacatcggcgatactgtaaaagtaatggaaacaagacctctgtccaaggacaagagatggagacttgtagagattatcgagaaagcaagataagcaggaaggagtaacaggtatggttcagcaggaaacaagacttaaggttgccgacaataccggtgcaaaggaacttctctgcatccgtgtgttaggcggttcaaccagaagatatgcaaatattggtgatatcatcgttgcttcggtcaaagatgcaacacctggtggtgttgtaaagaagggcgatgttgtcaaagctgtagtagtccgctctaaaaagggcgttcgccgcaaagacggttcttacatcaagtttgatgagaacgcagcagttgtgatcaaggatgacaagactcccagaggaactcgtatctttgggccggttgccagagaattgagagataagcagttcatgaagattgtctccctggctccggaagtattataagggggtgtccactgtgcataaaatcaaaaaagacgatttagtagtagtaattgctggtaaagataaagataagcagggaaaggttatctctgtagataccaagaatgacactgtgctcgttcagggctgcaacatggttaccaagcacaccaaaccggctgcaggcagcccccagggcggtatcgtgaacaaggaagctcccatggacatctccaatgtcatgctggtagttgacggcaaggcgaccagagtcggcttcgaagtgaaggacggcaagaaggtccgcgttgcgaagaagaccggcaaagtgattgattaattcaggagaggaggaaacttacgttggctagattaaaagaacagtatcagaacgagatcgtagacgctctgatcaaaaaattcggatataagaatatcatggaagtgccgaagctggataagattgtgatcaatatgggcgtcggcgaagcgaaagaaaatgccaaggttctggattctgctgtaagagacatggagatcatttccggtcagaaggcaatcaccaccaaggcgaagaagtctgttgctaacttcaaactccgtgaaggtatggcgatcggctgtaaggttaccctgcgcggcaagagaatgtacgaattcctggatcgcctggtaaacctggcactgccccgtgtacgtgacttcagaggtgttaaccctaacgcatttgatggcagaggaaactacgcgctcggtatcaaagagcagctgatcttccccgagattgaatacgataaagttgacaaggtaagaggtatggacatcatcttcgttaccaccgcaaagacggacgaagaagctcgtgaacttttgacattattcaacatgccgtttgctaaatagttaggaggaaatttttcatggctaagacttcaatgaagattaaacagcagcgtcctgctaagttctcgtccagagagtacaaccgctgcagaatctgtggtcgtccacatgcatatttgagaaaatatggcatctgcagaatttgcttccgcgaactggcttacaagggtcagatcccgggtgttaagaaggcaagttggtaatctggtaaagaaaaggaaggaggcaatttaaaatgacaatgagcgatccgattgcagatatgcttacaagaatccgtaacgcaaacactgcaaagcatgatacagtagacgtacctgcatccaagatgaaattagctatcgctgatatcctggtaaaagagggttatgttgccaagtacgatctggtcgaggatggcggtttccagaccatccgcatgaccttaaagtacggcaaagataagaacgagaagatcatttccggtatcaagagaatttccaagcccggcctgcgcgtttacgcaaacaaggaagagctgccgagagtactgggtggtctgggcaccgcaatcatttccaccaaccagggcgtgatcaccgacaaggaagcacgtcagctgggcgttggcggagaagttctggcgttcgtttggtaaggaaattttgacatgagctaagtgctcaatgtaactgaaaacagaagaggcgcagatgcctcttccgagaatttaagtaggaggtaatacggcatgtcacgtatcggaagaatgccaatcgcggttccggcaggcgtaactgttacaatcgcagaaggaaataaagtgactgtaaaaggtcccaagggaacattagagagagaactccccgtagagatgtccatcgaagagaaggacggacagattatcgtaagcagacccaacgacttgaagaagatgaaatcccttcatggtctgaccagaactctggtgaacaacatgatcaccggcgtaaccgagggttatcagaaggttctggaagtaaacggcgttggttacagagctgcgaagcagggcaagaagctgaccctgaacctgggctattcccatccggttgagatggaagatcccgagggcatcgagactgtaatggaaggccagaacaagatcatcgttaagggtatcagcaaagaaaaagtaggccaatacgctgctgaaatcagagacaagagaagacctgagccgtacaagggcaaaggtattaagtatgctgacgaggttatcagacgtaaagttggtaagactggtaagaaataattaaggagagtgtaaaaatggttaacaaacagtcgagaagcgaaattcgcgtaaaaaagcacaacagaatgcgtaaccgttttgctggcacagcagagagaccgcgtctggcagtgtttagaagtaataatcatatgtatgctcaaattatcgacgatacggttggtaacaccttagttgcagcttctacagtggagaaggacgttaagtccgagctggagaagaccaatgacaaggctgcggcagcatatgtaggcaccgtgattgcaaagagagcccttgaaaaaggtatcaaggaagttgttttcgacagaggcggctttatatatcagggtaagattcaggcattagcagatgcagcccgcgaggctggtctggatttctaagtaggagaggagaaagagcatgaagcgtacaattattgaagccagtcagttggagctgaatgataaggttgtagccatcaagagagtttccaagactgttaaaggtggacgtaccatgagattttccgctctggtggtagttggcgacggcaacggccatgtcggcgtgggtacgggcaaagccggagaggttccggaagccatccgcaaaggcaaagaggctgccgttaagaacctggtagagatccccatcgatgagaacaagagcattccccatgactttatcggaaagtttggcagcgccagcgttctgttaaagagagctcccgaaggtaccggtatcatcgccggaggcccggcccgtgcggttgtggagctggcaggaatcaagaatattcgtaccaagtccctgggttccaataacaaaacaaacgttgttcttgcaaccctggccggtttgaccgagcttaagactcccgaggagttcgcaagactgcgcggcaaatctgtggatgagattctgggctaataggaggaaatagacatggcagagaagttaaaaatcacattagtcaagtcccctatcggcgctgttccgaagcagaaagcaactgttgaggccctcggactgaggaagctgaacaagacagttgagatgccggacaacggtgctgtcagaggcatgattcagagtgttagacatttagtaaaagttgaagaaatctaatcagacaaagtaaggaggtgcagtcatggagttatctaatttacagcctgctgcaggttcaaagcatagcgacaatttcagaaaaggacgcggccacgcttcaggtaacggtaagacagccggtaagggccataagggtcagaaagctcgttccggagcaaccagaccgggctttgaaggcggccagatgccgttatacagacgtttgccgaaacgcggtttcaccaacattaattcaaagaccatcatcggaattaacgtaagcgcgctggagaaatttgagaacgattccgtagtgacagtagagaccctgctggagtccggaattgtcaagaatcccagagacggcgttaagatccttggaaacggagaattaaccaaaaagcttaccgtaaaggttaatgcattcagcgaaggtgcaaaggctaagattgaagctttaggtggaacctgcgaggtgatctaatgtttaaaacaatcaggaatgcatttaaggtgaaggagctcaaaaacaagctcctctacacctttatgatgctggtagtgatccgcttcggaagcgcgctgccgattccgggagtcagaaccgacttcttcgcgaattggtttgcaaagcagacgacggatgtgttcggcttcttcaacgcgatgaccggtggttcattttcacagatgtccatcttcgcgctgagcatcacgccgtacattacctcttccattatcatccagctgttgaccattgcaattcccaagcttgaggagctgcagaaagacggcgaggacggacgaaagaaaatccaggaatacacccgttatgtgaccgttggcctggcgctgatcgaatccagcgcaatggcgatcggattcggcagacagggcctcctggcagattacaacgcctggaacgttattgtcgccatcgtaaccatgaccacgggcagcgccctgctcatgtggatcggcgagcagatcacggataagggcgtgggcaatggtatttccatcgtcctgctgctcaacattctgtccagcgtacccagcgatatccgcaatctgtacttcaagttcgtgttcggtcaggatattcccatggcagcgcttcgcctggcgattgtcgttctggtgatcgtggcaatggtcgttttcgtaatcgtgttgaacgatgcggagagaagaattccggtccagtattcgaaaaagatggtaggccgcaagctggttgggggacaggcgtccagcattccgctgaaggtgaacaccgcaggcgtaatgcccgttattttcgcttcctccatcatgtcattcccggtagtgatctctcagttcattccggcgatgcagcaggggtggagcggccatctgatgaagctgctcaactccggttcctggtgcaggccgagcgagccaatctattccattggtctgttggtgtatatcatcctgatcgtgctgtttgcttatttctatacttccatcgcgtttaacccgctggaggtagcgaacaatatgaaaaagcagggcggctttatccctggcatccgtccgggcaagccaaccagcgaatatctgaataaaatcctgaattatattgttttcattggtgcggtaggcctgatcgttgtatgtgtggtgccggttatcttctccggtctcttcgatatgagccgtatctcgttctccggaacctccctgatcattatcgtgggcgttgtgctggagacaatcaaggcaatagaatctcagatgcttgtgcgttattataagggatttttgaacgattaagtgatcaatctgcctttgtggtattccacaagggcggattaattgcgtttagaggcggcggcgggcctcgtgcaggcctgtcaatgcgccggaaaggggaccatttccatgaagattatcatgttgggcgcaccgggtgccggaaaaggcactcaggcgaagaagattgctgcaaagtatcagattccccacgtttccacgggcgacattttccgtgcgaacatcaaaaacgggaccgaactgggaatgaaggccaagagctacatggacgcaggcgggctggtgccggatgaaatcaccatcggcatgctgcttgaccggatccatgaggcggactgtgaaaacggttatgttttggacggattccccagaacgattcctcaggctgagagcctgacccaggccctggcggggatggacgagaaaatcgactatgccgtcaatgtggatgtgccggatgagaacatcatcagccggatgtccgggcgccgggcctgcttaaactgcggagccacctaccacattgtgtataatcccccgaaacaggagggcgtgtgcgatgtgtgcggcgacaagctggtactcagggacgacgataagcctgaaaccgtacagaagcgcctgagcgtttaccacgaccagacccagccgctgatcgagtattatgagaaggcgggagtcttaaagcaggtggacggcactcaggatatggaagctgtatttcaggatattgtaaagatcttaggagcatagaacatatggtaacgattaaatcagaacgggaaattgaactaatgagagaggccggcaggattctggcaaaggtccatgaggaacttggtaaggaattaaaagccggtatgtctacaaaggaaattgaccggatctgcgagcagttgatcagaggctacggctgcatcccttcctttttaaactatgaagggtttcccgcatccgtgtgcgtgtccatcaacgatgaggtagtccacggcattcccaacaagcaccgctacattcaggagggcgacatcgtcagcctggacacgggggtgatctggaagggctatcagtccgacgcagccagaactcacatgatcggggaagtgacgccccaggcgagaaaactggtggaagtgacggagcagagcttttttgagggaataaagtacgcgaaagcaggcaatcatctcaatgacgtatcttcagccatccaggcgtacgcggagagcttcggcttcggcgttgtgcgcgatctggtaggccacggaatcggaaccgagatgcatgaggcgccggagatccccaacttcgccacacgccgcaaaggaatcaagctggtggccggtatgacccttgccatcgagccaatgatcaccgcgggccgctacgacgtagtgtgggacaatgacgacggctggacagttaccacagaagacggttccctggcatcccactacgagaacaccatcctgattacggatggcgatccagagattttatcgctgtagccgaggtgatccgatggtagagtttaagaccggcggtctggcgaggagcctggccggccatgacaaaggccaactgtatatcataatcggcgtcagtggagaatatgttactctgtcggatgggcggaaacgtccttcagacaggcccaagcgcaagaacaaaaagcatttgcagctgattcatggatatgatgaatgcttgggaacgaaaatggagagcggcgtgagcgtgagggacgaggagatccgttcctttataaaggctcaccagcagtaggagggaaaggaatttatgtcaaaatcagatgtgattgaaattgaaggaaccgtagtagagaaattacccaacgccatgttccaggtagaactggagaacggccatcaggtcctggcacatatcagcggaaagcttcgtatgaactatatccgcatcctgccgggcgataaagttacgattgaactgtccccatatgatttgtccaaaggaagaattatctggagagataaataagcagacctgcggtctgcgctatccaaacgcagccgaaggcggaattcgggtttcccgggggcacagtgaataacaccccagtgaaaccggaatcaatcacccggaatcaccaccccggaatttgctcttcacccgcgcgacacaccaggggcagatgatcaataaatatatagcaaaaagtgcttgcatttatcgaaaatcaatgatataatgctttagcaactttgttggtctatagaaaggagaattactgtgaaggttagatcatccgttaagccgatctgcgaaaaatgcaagatcataaagagaaaaggcagtatcagagtaatttgcgaaaatccgaagcataaacagagacaaggttaattaaaaattaggaggtgtactacacacatggctcgtatttcaggtgttgacttaccaagagaaaaacgtgttgagatcggtctgacttacatctacggtatcggtagaacaagtgcgaaccgcatcctcacagaagctggcgttaatcccgatacccgcgtcaaagatttgaccgacgacgaggtaaagaagctggccaccatcattgctgacactcagactgtggaaggtgatctgcgcagagagatcgctctgaacatcaagagactgcaggaaattggttgctacagaggaatccgtcacagaaagagccttccggttcgcggccagaaaaccaagaccaacgcgagaacctgcaagggaccgagaaagacggtagcaaacaagaaaaagtaattaagtaacacggtaactgaattcgatttgtatgttttaaaaacaggaagagcgaattcgagaaaatgagaaagtaggttagtttaaaatggctaaaaaagtgtccactacagctaaaaaagtgacaaaaaagcgtgtaaagaaaaacgttgaacgcggacaggcacatatccagtcatcttttaacaatacgatcgtgacgttgacagatgcacagggtaacgcattatcttgggcaagtgctggtggtctgggatttagaggttcaagaaaatctactccttatgctgctcagatggcggcagaaactgcgacaaaagcagctcttgtacatggtttgaaaacagtagatgttatggttaagggtcctggttcagggcgtgaggccgcaatccgtgctctgcaggcatgtggattggaagtaacaagcatcaaggacgtaaccccggttccccacaacggatgccgtccgcccaagcgtagaagagtctgattaggaggtaattaaagtggcagtagatagagttcctgttcttaaaagatgcagatccctgggactggatccgatctttctgggaattgataaaaagtccaacagagaatccaaaagaaccaataagaagatgagtgagtacggcctgcagctgcgcgagaaacagaaagcgaagttcatttacggcgtactggagaaacccttccgtaactactatgcgaaggcttccaagatgaacggtatggttggtaccaacctgatgatcctgttagagtgcagactggacaatgtcctgttccgcatgggccttggccgcacccgcaaggagacccgtcagatcgttgaccacaagcatgtgctggtaaacggcaagcctgtgaacattccgtcttaccgggttaaaaccggcgacgtgatcgagatcaaggagaaatacaaatccgctcagagatacaaagatatcctggaagtaaccggcggacgtatggttccggcctggctggatgttgatcaggagaacctgcgcggcaccgttaaagagatgcccaccagggacgagatcgatgttcccgtaaacgaaatgctcatcgtagagttgtattctaagtaatctctgtgttagaatgcatccatccctcgagatttgatagaaacccaaaaggaggggctattagtgttcgattttgaaaaacccaacattgaaatcgcggagatttcagaagacaagagatatggcaagttcgtagttgaaccacttgagagaggttacggcactacactgggcaactccctgagaagaattatgctttcttccctgccgggtgcagcagtgagtcaggtaaaaatcgatggcgttttgcatgagttcagttctatcgccggtgtcaaggaagatgtaactgagatcattatgaacatcaaaagcttagcgatcaagaacaacagcgataccgacgagcccaaggttgcttacattgagttcgaaggcgagggcgtgattaccgcagccgacattcaggcggacgcggatatcgagatcatgaatcctgatcagatcatcgcgaccttgagcggcggcacggacagcaagttctacatggaacttacgatcaccaagggccgcggctatgtcagcgcagataagaataagaacgacgatttacccatcggggtgatcgcagtcgattccatctacactccggtggagcgtgtgaatatggcggtggcgaacacccgtgtcggccagcagacagactacgacaagctgacattggagatctacaccaatggcactcttgcacctgacgaggcagtcagcctggccgcgaaggtactcagcgagcacttaaacctgtttatcgacctctccgagaacgccaagacagcagagatcatggtggagaaggaagacaacgagaaggaaaaagtgcttgagatgaatatcgacgagctggagttgtccgtccgttcttacaactgtttgaagcgggctggaatcaataccgtggaagagctgtgcaaccgcacttccgaggatatgatgaaggttcgtaacctgggccgcaagtcccttgaggaagtgttggccaagcttaaggaattaggcttacagcttaatcccagcgacaacgactaacgatacatttaacgcgggaccagtaagtccaaagaagcatggtttccgtgaagccaaaatagtgtgcgggaaatcagtgccctggtcagtaagtccataagaagcatggccggggtgctccgcagtgacggaggaaaatgaaatggcaggatatagaaaattaggaagaacttccgaccagagaaaggctatgatcagaagccaggttacagctctgctgtaccacggcaagatcagaaccactgagaccagagcaaaggaaatccgcaaagtagcggagggcctggtagcgatggctgtcagagagaaagacaactacgagaccgttaaggtgaccgctaaggttgcccgcaaggacaaagacggcaagagagtgaaagaagttgtggacggcaagaaagtaaccgtttacgacgaggtcgagaaggaaatcaagaaggatatgccttccagactgcatgccagaagacagatgttaaaggtgctttacggcgtaaccgaggttcccacctccaacgctggcaagaagaaaaacaccaagagcgttgatctggttgcaaaactgttcgacgaggttgctcccaagtacgcagaccgcaacggtggttacaccagaatcgttaagattggtcagcgcaagggcgacgcagctatggaagttctgatcgagttagtttaatcggatatcaatgaaccgcaggtacgaaaaacgtgcctgcggttttttgatagagagaacgaaatacaccctaatcatacggtgaacggcaggttttttggaacctgcttttttgcttttccggatataagggcggttggaggccgcttttcattgatccggagggcgattaaaatattgtaatataattcgtaaaaagagcttgaaaatatattatatataatgtataatatattttgtcaggagaaaggcgcttgacggccaggcaatcaagggcgatggcgccggaaaaatgtaatgtaccaggaggaaaacatgagaagaaaggtatcagggttacttgtgtgggctctgtgcgcagccgtgatggcgggctgcggcaattcaggctcggagggatccggcaaagcggagagcggggaagtcaggcaagagagtgcaaagagcgggggaaaggggaagacagtgcgtctggtgatcggttccggacctatgggcggggcgctctatcccattgcaggtggaattgccgctatcatcaatgaacatgtggaggggggcaatgcctctgtgcaggtcacggccgggggcatcgagaacaccagaatgatcggcagcggtgagattgatttgggattgtcctcagctcagcaatgttacgacgccgttcacaacagcggtatgtacgagggagagaatttacagctgaatgtgctgggtaccctgcactcgacggtgacacagattgcggtgcttgcggattccggtttaaaggatgtggaggacctgaaagggaaaaaagtagccatcggcgaagccggcggcggtgcggagcagcagtttaaagaactgattgctgcgctgggctggagtgaggacgatgtggatatggtctatctgccgtatgatcaggctatggatcagctgggggacgggctgatcgacgcgggcgtggtgtgctccggaatgccggcatcttccatcagcaacctggcaagccgccggaaggtttgcctgttaaactttaaccaggcaacccaggaaacctggagtacgtcggtggatccgttcctaaatgtgtttatccccattccggcggggacttacgcgggaatggacgaggatatttacacagctgcggcctatatccagctgtcctgtcgctctgacctggatgaggaactggcatatgaaataaccaaagcgatctacgatcatctggacgagctgtcaacttaccatgcatcggcggcaacgatcacgaaagaatcggcgcccaagatatcaggagcagaatttaatccgggagcgaagcggtattttgaagaagagggattgctgcagaactgatgacaggagcacttttggtaagaaaggataatcgattatgggtgcggtaacagaaaagacttgggtaaaagtcctctcgggtatcaccatggcagttgcgtttatggggggcatgcttcatatttataacagtgcgttcggaacgatttctgcatttcagatgaggccgatccacgtggggattgtgggactgttggcagtgctgatggatatggtctccctgaaagataagaagcacaaggcagtacatatcgttttaaacggattggttttgttctgtgttttggcagggatcagcgaattgctgtttcactacagcgaaatcgcgcagaacgcagggcttacctccgaccggatcaccatctgcagcacgctgctggtgatcagtattctatatctgacatccaggaaagtggggaaggctctggcgattgtcgcggtggtatttatggcctatgcattgctggggcagtaccttccgggtattctgggacatcggggatattcctattcaagaattatgtatttcctgtatgtgaacggaaatggtattttcggcgttcccatcgacacatctgcccgatatctggtgttgtttatgatcatgggcgaatttattgagctgagcggaaccagcaagctttttatggcggtggcggattatgtttccagcaaattgcggggcggagcggcaaaatcgtcggtggtggccagcgcattgtttggctgtatctccggcacgcccatagccaatgtgatggtgacgggatcatttaccattccgatgatgaaaaagagcggatttgaagatgatttcgcagcgggagtggaggcgacagcgtccacgggaggtctgatcatgccgccgatgatgggggcgggcgcctttgtgatggcggagcttctggggatcagctatggcgcgattatggcggcggctgtaatacccgccatactctattatttctccatctatctgtcgattgacttttacgccttcaagcataagatcggcagagtggaggataccaatctggaagaaattaaatcgaatataaagcggtatgcgcacaccattcttccactggtattttttatcgtcagcgtgattgcgggatactcggtattcagaagtgcaattatctgtatcgtcatgactccggtgattgcagccttccgcaaggagacgagaatgacggtcaaaatggtagtggatgggattgcaggtggaatgaaatcctcggttagcctgggagctgcctgcgcctgtgcgggcattatcgtgggaatcgtgtccctgaccggttttggattttcatttgcagagttgctccggctgttcggaaacgtaccgattgtggcgctgatcattaccatgttagtctgcctgatcatggggatgggaatgccggcggtggcttcctatatgattacagcgacgattgcggcccccacattgattgagatgggcttcctgccgatcgcagttcacatgtttgtattctacttttccggtttctcgtcggtgacgcctccggttgcgctggccagctatgcggcggcgggaatcgcaagaagcaatccgatgaaaacgggatggcaggcgtttaaacttgcaatcgtggcatttttagccccttacttctttgtgttctcacctgcgctgattgcgcagaccggaggatttgagctgttgaccacggttccattcgctctgatcggaacgtatgcgttcatttgcggaatgcgggcctatttctggggacgggacttaaacaataaaggactgcgggctgtgattatggcaggcgggctgcttatgatcattccgggaatggcaacggatataattggggttgggttgttggtgatcgtttacatgacagagtgtatcatgcgaaagaggagaagtgaatatggcaaagaaaatattggaggtatttaataagtatacggagtgcatgggcgacacgatttttggtcactggacgcccagaatggtggttgccgggatcgatatgagcgacgtcctgcgtatcagggcccagaagcctgattggagcgattggccggctctttgggaaaaactgggagatgagcatctgaaacgcggtgacgacagtctggcggccggtcataccgttacagccggacaggcataccggatggcagcattatcttatcactacgggcattttatgctgtttgaccggcctcagctcaaagagcggctgatgcgcaaaagcatggctgtgctggaccagggacttccctatcagagatttccagggaaacggttgtacctgcaatgtgagcagtggaaaattccggtcctattctttgaacatccggattccgcggggagaattttacttttgacaggaggggcggatgcaaacaaagaggaaatgctcagctttgccgatgtatttctggagagaggaatttccgtctttattatggatggacccgggcagggggaagctgcctatatcgcgccttacagaagatccatccataaaaggtttgtcgatacagccgttgaatatatgaccgggatggggtatgatcggctggccgtaggcggaatcagcatgggcgggcatttctgcaccagagcggcggcggtcaaccatcgcttcatggcggcatttgactgcggcggaccctatgatatgagggatttgggatccaaaatggacgctctgttcattggagacgtgggtcatgtgctgggaacggatgattgcgaggaactatttcaactggcagccagcgagctgacactggatgacgttatttccgaccttacctgccccctgatggtgattcatgggacgttggaccggattgtggactgcgctcaatcttatgagattgttgagaagagtaattccgtggaaaagcaccatatcgtgatcgaaggtggaaaccacgtgtgcaacaactatgtgtaccggtaccgtcccgtcattgcggactgggtggttgaaaaattatcggcaggaggtaaggaatgaaactttacgacgatacggttttaaaggatgcgatcgatatacacattcatgtggggccggattatatgccgcgatacgccgatgccatcacgctggctgaggaggccagggatgcaggtatgaaggcgattgttgtaaaatgtcacctcaccagcacggtgggggctgcccaggcggcctgccaggctgtgccggaggtgaaaacagtcgggagcatcacgctgaacggcacggtagggggactgaaccccagaagtgtaaaggccgcggttttgtccggcgccggcgtggtgtggctgcccacggtggatgcccagtacgccatggacaaggccggagaaggccactggatcggccattatgtgaacggttcaaatttcggctatccgtgttcccgactttccgttacggacggtgagggtcaactgaaggaagaagtcaaggaaatcgttcggatctgtaaggaatatgatgtcctgctctgcagcggacacatcggtcccaatgagtgccttgccgtggcggaatatgcgaaatcgattgggtttgacaagttggaaatcacccatgcgaacgcctggtttgaggatttttcgatggatgttctgaaacggctggcagactgcggcgctgtcatcagctgctcgctgggcgccatggcgccacacaatgggcgggaagatccaggagaagtagtggagatcatccgggagataggcgctgaacatgtggttttgatgacggattacggccagatcaacgctccatctcctgctcagggcatgagggtcttttactacctgatgcttaagatggggattacgaaggaagaactggagttaatgatgaagaagaatcctgcctttttattgggcctggaagcgggaaaggagcattcggatgtattataaagaaaacgcgtggtgggcgagcccttataacgacaaggaggaggtgcaaaaatatgcgtcgccgggccatccggttatcattcacgacgcaactctgcgcgacggtgaacagactccgggggttgtattttcgccggacgataaattgagaatagccgagaaattggtagcggcaggcgtgaccaggattgaggccgggatgccggccgtctcccaggacgactttaaagcggtccagatgatcagctcccatttcccacaagcggaagtttacgcattttcccgcgccatgcgaaaggatatcgacatggcacgggaggcaggctgcaaaggggttgtggtggaagtcccgatcggatatccgaagcttcaatctcaattccactggacttgggagaatgtattggagaaaagcgtcgattgcgttaattatgcccatcagcaggggctgcgcgttgtttatttcccttacgatacgacgcgggcgagggaagcggatttagagagtctgttgaagggcgtgatgaagcactgccctcctgattcggttggcctggtagataccatgggctgcgcaatgccccaaaccattcagtatatggtgcgctggatgaaaaagctgactggcaatctgccgctggaagttcattgccataatgattttggtatggcggtggcgaatgaactggcaggcgttgcggcgggagctgaggtggtgcacggctgcgtcaatggtttgggggaacggaccggaaacgcggcggttgaggaactgattatggctatgaatattctgttgggcatgaatacgccctatgacctgacaaagttgaaagaattatgtgaagtgacggagaagctttccaatatatcctgcgcgcccaataagccctttgccgggaaacgcaattacaccagggaatcgggaattggcgtggatctggtaatcaagcagcctcttgccatgtttgccacagatccgcggtattttgacagggaagcagaaattgttttgggcaaaaaaagtggaaaagcgtccatttcttatgcgctggagcagctgggcttagaagccaccggggatcaggtgacggagctgctgtcggaggtaaaagcaaagggcgtggagaagaaagggctgttgacgatggaagaattttcatcgattgcagacagcattttacagtaacaaaacgggattccgcataaaattgcaggtaaaagcttgccaatagatagatggtgatataaaatgacttttgtagatatgcagactgagcatgcggagtcttattatttttggttttgattctatataatatatgataaccggagaaggattgcgaagctcagtacgttgattcagaaattggagagatcaggatgaaacaatacaaaacaaaggttgaccttatttatgacattttaattaaagatattgaaagcggcagatataaaccgggggaacgattggtgatcagccagatttcaaagaataatgaagtcagcgatattcctgtgcgtgaagcaatccggcgtctggaaagcgaaggttatgttcagctcaatgccaattatggtccggtggttggcgacttttcgttagatcacctaaatcagatttttcagattaaggctgtgctggaggggtatgcggcccgtctggcctgcgatgtgctgaacgaacatgattttgaggaactgcggaaatataatgatcggattcatcaggcggcggaaagcgggaatatgaagctgtgtagcaaactgaacatggagtttcatctgcggatttaccgtgatataccggtgacggaactgctgaagatgatcgaggagctgtggaaaaagtacagcattacaaaacgcgttttttcactggtttcagatcgggcggataacagctgcaaggagcatgaacaaatattgaaattgatggaagcaaagcgatatgacgaggtagaggcggcggtacgcctccacaagctgactgccggtgaaaagatgaccgatcaattacgcggcaagggctccggacaataaaataacctttgcttatcccgctctcccgctgagaatttccggtggaaaggataagcatgataaaaacagatgaattgttagccagaaaagccagaatacgggccggcggcggcgcagccagaattgcagcccagcacaatgccggtaagctgacggcaagggagcgcctggagctgctgtttgatccccatacctttgtggagatcggcgcattccgcagacatcactgtgcagattttggcatggatcaaaaggaggcgccgggcgacggggttgttaccggatacggccgcgttgaaggccgcctggtctatgcctacgctcaggattttactgtactggggggatctctgggggaggttcacgccgaaaaaatatgcagggtgcaggacgaagcgctgaagaatatggctccgatagtcgggcttatggactccggcggcgccagaatccaggaaggcgtcagcgctctggctggatttggaaagattttttaccggaatacgctttgttccggtgttattccccagatcagcgcgatcatgggaccttgcgcggggggagcggtgtacagtccggccataaccgattatatttttatggtggataagaccagcaatatgtttatcaccggaccggatgtgattaagacggtaaccggggaaacgatcacagcggaagcgctggggggcgcggcggtgcacaaccagacaagcggggtgagccattttctggcgcgtgacgaccggtcttgtctggcggacattcgaaaattgctgagttatctgcctggcaattacatggagcaggtgcctgtaagaaagacgggagatgatccggggcgcctgattcccgccctggatacggttcttccggagactgccagaaggtcctacgatatgcacgatattatacggcctcttttggatcagggggagtttctggaggtacaggaagattttgccaaaaatttgattgtcggatacgggcgcgtgaacggtcgtaccgtaggggtggtggcgaatcaacccaacgtggctgcaggctgcctggatgtaagcgccagcgataaggcggccagatttatccgctgctgcgatgcctttaacacgccgctgataaccctggttgatgtgccgggattcttgccgggcgtttcccaggagcatcaggggattatccggcatggggcgaaaatgctgtatgcatacagcgaggcaacagttccaaagattacggtagtgatccggaaagcctatggcggcgcttttattgggatgtgctgcggcgcactgggagccgatatggtatttgcttggccggaggcggaaattgcagtgatgggggcggaaggggccgccaatattatctttaaaaaagatatcagccggtctgcaaatccgcagatggtgagaacggagaaaatagcagaatatgtaaataagttttctggtccgtattatgcgttggagcacggatatgtggatgatatcatcattcccagggaaaccagaacccggttaatcgacgctttggaaagcctggcgggaaagcgggaacgcctgccggaaaagaagcacgggaatatcccgttgtgagagatatttgtatagagaaccggaaatgccatatggcctttgggaggaatcctgaaggccatatacttttgtcagaacttcgcaaatattatgaatttaccgaaagaatatcgtaagttgacgtggacagcggcctcgggctataatgattacagataatagattaaatatgtgcgatgggggttgccccttttaaggaggttatcagtatgatgaaatggaaacggatgctcggcgcgctgatggcagcgggactgctggtgtctgcgatgcccatggaggctttggcggggaccaagtatgtcaccagtatttcgctgaaggttcacgctgagttggaggcgggggattcagtgggggacaatgacgatatcgcgtatgagaaacaggacagcggtacttacgtgtatacaacagccagccgttatcatgtggtaggagcggagtgggccaatgacaaggacatctccatcggcgatgagcccaagatgtatgtgtggctggagattgacgacgatgataacgaaaatgagtataaattccgcagcagctacagctccagcaatgtgagcgtcagcggcggaagctatgtgacctccagcaagagcggctcggatttgaaggttacgatccgggttaatcccatcaagggcacctatgacccgccggagaacgccgagtggggaagctcccgtgggcgggccacctgggacgccggggacagcagctccggttactatgacgtgtatctgtaccgcggctcctcgacggtgaaaaaggtggaggactacaagggcaccagctacaacttctatccctatatgaccaaggaaggggactacacctttaaagtccgtaccgttcctcacagcgacagcagctacggcaagaagagcgactggacggagtccgacgatctttatatcgacgaggaccacgtttccgacggctctgggcagagccgggacgacggtgtgacctccaccggcggcaccacggatgtgggctggcgcaaggacaacgacaaatggtattttaaatatccggacggcacctatgccaagaacggctggatgaaatggaacgacaagtggtatctgttcgacagcgttgggaagatgctcaccggctggcagcagaacggcggcaactggtattatctgggtgagaacggcgatatgaagaccggatgggtgaagtccggcaacctctggtattactgcaatcccaaccagggcggcccggagggcgccatggtcaagagctgctggcttacgatcaacggcaagacctattttatgaacgagagcggagccatggtggagggctggtacaaggtaggcgaggacttctactatttccagccgggcgaaggccacaaactggtgaacaccacggtgaacgggttcgtgttggatgcaaacggagtgtggcgtcactgatgaggggacggcccgggccggaggaagttgtgagagagagctgtgtgggcgcatttttcatatagaaaatcataagccggcgaacggcggaaggagtttcaatgaaaaagagacaggcgatggctgtgatgacggcggcgatgctgctggccgcgggcacagcgatgatatcccacgcggcggagaaagagtatcagatttacgtgtccaacaattatgacacgcagaacgtcagcgcggacgacaacgacgacgagaaggtccatccgctggccccggacgtttacagcgacgactacgagatcatcgacggtccgtcctggtccaaggggctgttaagctggacgccgggtaagacggtgacgggaaccatttacgtggatctggacagttcgtccgcggaatccatcggcaagagccggacggagtttgtcatggccgacggcgaggacaatgaggtggagatcacctccgtggagcgctacaaaggcagtaaatacgagggcgacaatatctacaaggtaaagttcagctatcaggtggcagcccagttaggcgacaccacatgggccggctgggacagcgcaaatcccacgctggcgcgctggaacggcgtcaagtatgccaatacctaccgtgtggtcctctatgacgaccagggctctgtggtgacccagacagtggagaacgccacatcctatgatttttcgcagtttatgaccagggaccgggtaaattattactttgaggtgacggccatcgcccgaaacggggatcagcgggattatctgaaggacggaggtccggtcagttctctggggtccgcctccaacaatccgggaatcacggacggcacctggggcgattaccagcagggccgccgttttaccaaggcggacggaaccaacccggcgggctgctgggagctgatattgggaaagtggtattattttaatgccgggggatatgcggttaccggatggaatgagattgacggaacatggtattacatgtatgaggacggcgccatggcggccgggaccacaacaccggatgggtatgtggtggacgggagtggggcgtgggtgcagtagttggattgaaattttaaatttgcaaaggtgtaaagaaaacttctttacgccttttctttttttgaataaaataatatcggagctggatgtcatcagagcattggttgaggctagaatttctcaaaaccttacacaaaaggaattagctgcgcggactgggattgatcaggcggatatcagcaaactggagaacggaaccaggaatccatctctgaatttgctgaagcggcttgcagtcggcatgggcatggtattgagaattgaatttgtgccaaagcgtaaatgaagccgtcatgatgtctaaaataactaaaaaaacataccacaagttcagaaatcgcgacattattacttaaatgccggttttttccctccttattttctgatatgattggatcatcagagaaaaggagggatttttattatgaagaaaaaactgtcacttttgttggcgtgtaccatggctttaagccttaccgcgtgcggcggaggcaagaccgaggctcctgcgaccactgcggctcctgagacaactgcagcgaccgaagctgcaaaggataccgaagcggcggagtccaaggcggaatctgccgaggccactgaggcggccggcggcatggatgcgctgattgaggcggcaaaggccgagggagagctcactgtttacggctcctgcgaggaggagtatctgtccgcagcctgccagaattttgagaagctctacggaatcaagaccaagttccagagactgtccacctccgaggtttacaccaagatctccgaggaagctggaaaaccgtccgctgacgtttggttcggcggcaccacggacccctacaacgaggcgaccgcagacggtctgctggagccctatgaggcgatgaacgcagtgaacctgatcggcgatcagtacaaggaccccaccaactgctggtatggtatctacaaaggcatcctgggcttcatggttaacaccgaggagctggaccgcctgggcctggaagctcccaagacctgggatgatctgaccaaggaagagtacaagggcctgatcatgctgtccaaccccaacaccgcaggcactgctaagctgctgatcaacaccatggttcagatgaagggccatgacgaggcgatggaatactttaaggcgctggacaagaacatttcccagtacaccaaatccggttccggtccctccaagatggtaggcccgggcgagtgtgtgatcggtatcggcttcctgcatgacggcatttaccagattctgcagggctatgacaacattcagctgatcgttcccgaggatggaacttccttcgaggttggcgcaaccgcaatcttcaagggttgtacacatcccaacgcggcaaaattgtggattgagtacgctctttctcccgactgtgtggatcatgccaaggagaacggctcctatcagttcctggtacttaagaatgcgactcagccggaagaggctaccaagttcggtctggatatgaacaacaccatcgactacgatttcgaggatgcaaaagagaacagtggaaaatatgtggaggacttcttcgcagcactgggaagctccaaggacaacgcagattccagccgtttcaaaaccgagtaattgaaaacggtgccggctgcggcacatgttaggatcgtaacaactcgtgggagagcgctgcgaaatgccgaaaatacacatttcgcagcgtttttattgccaggagagctcattttcctgccaataaaaacgctccaaagggggcgctgcccggcggacgggcggtctgatctccggccggactgcaaatgattcatgcactgtaaacattgttgaagatagaaaggggggcctttttgtggccagaagtcaaagcgctgagctagagcgcaagaaattctttgcggacccatttttggtcagcatgatcgtcgtgctgctggtgttcctggcattatttatcctgtatccccttctgatgctgctggtagacagcttttattcggaaggcaccgtgaccatggacgtgttcaagcgggtgctcagcctggaacggttcagaaatgcatttaaaaataccctggtgctgggctttatcaccggcctgacctccacggccatcggccttttgttcgcctatgtggaggtttacgtgaagctgcgcaccaaggtgctggagaagctgttcagcctggtatccatgctgccggtggtgtcgccgccctttgtgctgtccctgtccatgatcatgctgttcgggcgcagcggcattatcacccgctccctgctgggaatctacgattcaaatgtctacggcctgaagggcatcgccatcgtgcagaccctgacctttttcccggtctgctacctgatgttgaagggcctgctgaaaaatatcgacccgtccctggaggaagccacccgggacatgggcgcttcccgctggagggtatttaccagtgtgacattccccctgctgcttcccggcctgggaaatgcgttcctggtgacctttatcgagtcggtggcggatttcgcaaaccctatgctgatcggaggttcttatgacaccttggcgactaccatttacctgcaggtgaccggggcctacgactccaccggagcggcggccatgtctgtggttctgctgatgttgaccgtggtgctgttcctgatccagaagtattatttggagaaaaagacggcggccaccctgacgggcaaggcttccaggatgcgtatgctgatcgaagacaagagcgtgaccgtgcctctgaccatcttctgtggctgcgtagctgcgtttgtgctgctgatgtacataatggtgccctttggcgcactgtttaccctgtgggggagggattacagtctgagcctgaaatggttccagtacatgttcaagaccagcgggttgaaggcatttaaggattcctttatgttatccctgatcgctgctccgctgacggcgttcctgtccatggtgatttcctacctggtcgtcaagaagaaattcaaggccaaaggttttatcgagtttgtttccatgctggccatggcagtgcccggaacggttctgggtatcggatatatccgcggttatgccaacggcctgttccgcaccggcattatgagcgggctgtacggcacggggctgatcctgatcatcgtgttcattgtgcgaagccttcccaccggtacccgaagcggcatttccgccctgcgccagatcgacaagtccattgaggaatcggcctacgacatgggcgccaactcggctaaggtgttcatgacggtgacgctgccgctgatcaaagactccttcttcagcggcctggtaaccgcgtttgtgcgcagcatcaccgctatttccgccatcatcctgctggtaactccggatttcctgctgattacctgccagatcaatgagcaggcggagaaaggaaactacggcgtggcctgtgcgtacgctacggtattgattattatcacttacggtgctgtattgattatgaatacgctgatgaaattcttcggcgtcagcagaaagatcaaggaggagaattaaatggataagcagaaaaaaggcgttcgtctggagcatatatcgaagatttacaaggatcccaagaccggcaaggatttctacgcggtgcaggacaccacgctggatattgagccgggaacatttgtcaccctgctcggcccctccggctgcggcaagacgaccacgctgcgcatgatcgccggtttcgagagtccggacgagggcgacatctacctgggggacgaggcgatcaacgccctgacgcccaacaagcgtgacacggctatggtattccagagctacgcccttctgccgcactacaatgtgttcgacaatgtggcgtatggactgaagatccgcaagctgcccaaggaggagatccaggagcgggtgatgaatattctgaagctggtggagatggagggcatggaatcccgcatgaccaaccagctctccggcggccagcagcagcgcgtggccctggcccgggcgctggtgatcgagcccagcgtgctgctgttcgacgagccgctgagtaacttagacgccaagctgcgcgtgaccatgcggacggaaatccgcaagatccagcagaaggtgggaatcacggcgatttatgtcacccacgaccagtccgaggccatgagtatttccgacaagatcattatcatgagcaaggggaaggtagagcagatcggcacgccgcgggagatttactatcatccgacgtccaagttcgtggcggacttcatcggcgaggccaacttcctggaagcccaggtacggtccgcggacggcgagaaggccatgatttcagtagcaggcggcgaattcgaagtcaacaacttcgcccacgccaaagccggtgaaaccgccacactggtcctccgtcccgagggcgtcagcctgtccgagaaaggactgctggaaggaaccgtaacgctgtcgacatttatgggagcgtatcagtattatcagatgatcgtgggagatattgagatacagatcacggattacaatccggtcaaccggcggatttatgaggtcggagaaaaagcatacctcgatttcgaccccaaaggggtttacatattgtagggagatagtatcgtatgaacacttgacgaggtctttcacgagcttagtgtttgtggtataatccaggtaggcaatgagcagtgcgtgaagggacatatgcagagccacgtcgtgctggcacgtaagtggagctgcatatggccgttcacatagggcgaagcccgtgagcgagatgaagcgaagcggaatcgagctgcactgcggagtagcgagacgcgaaggtgcgtgaacggaatcgacctgcgctgcgggctagcgagacgcgaaggcacataatgccccctcaacaaatccccctcaaaaacaggactcccaaaactatgaaaaacaaacacaattacatcaccgccgccctcctatttctcctgctagccctcaccggctgtgcaggcagaaatttagggcgcccggcggacttaaaaacggatgaggcgctggtcatttactgccctcatccgttggattttataaatccggtggtctccgagttcgaggagcgcaccggcataagcgtgcaggtgcagaccggcggaaccggcgagctgttggagatggtggcggagcagaagcagccgcgctgcgacatcttctggggcggttccctctccaccaccatagagcgccgtgagctgtttgccccctacatcagtgaaaatgagagcgtagtgcggtcggagttctgcaacgtggaggggaacatgacgcggtttacggacgttcccagcgtgttgatggtgaacaccaacctgatcggcggcatttccataaagggctaccgcgatctgctgcagccggagttaaagggccggatcgccatggccaacccgtccgtttcctcctcgtcctacgagcatctgatcaacatgctgtacgccatgggaaacagcgatccggaaatgggctgggactacgtgcgggccttctgtgaaaacctggacggaaacctgctggagagttcctccgcggtctacaggggcgttgcggaagggcgttacaccgtggggctgacctttgaggagggcgcggcccactatgtggcaggcgaaaacagcgcggtgaagctggtttacatggaggagggcgtcatttccaaacccgacgtggtgtgcatcgcggtgggagcggagcatgtggcggaggccagggcctttgtggactttgtgacaggccgtgacgcccagaccatgatcgccaccaccctggaccgccgttccgtgcgcacggacgtggaggagccggactatctgccggacaaggactcccttcatatcatttatgacgatccggcggtggtcaacgaaaataagcagaaatggctgagccgttttgacgacatattccgggcaaccctgacggaaggcgggaagggggcggcggaatgaaaaaagagcggtattttcgggacgagctgcgcaagcttttcatcggttacgccatcatcccttccgtgctgttcaccctggtctgcggccttgtatttcttgcagccctcatgcagggaaagatgagcggaaatgaacggcacaaccaatatgtggccggggagctaaaccgggtgctgacggcctacgggaatgaactggaagagctggcggcgcagccggatttattttccggggaaatgaacaccgaccgccaggtgtacattttccgggacttttacagcgtttccaatgagcttggatacgaggcggacctgttcgtgctggatgcggaccggaatccggtcatgtccagccgctctgcgctgccggagtatctcaaagtggatcccgacgtggactggggtatttttgcctccatggaaacgcgaccgggcgggactgcggtccgcctgatggacgggtggaagaagcaggaccgggatattgccctggggcggaccattctgaacggggaggagacggtggggtatctggtgttcgcgatcaacagcagccggtttcagccggccctggaccaggcggacacgcagattctgatcgcggaccggttcgggcgcatttttctgagcaatacctacaattttacggataaaagcaaccaggtgatcgaagcgctggagggagccgggcgatatctgcactacgataaaaacctgtatctggcgggctgccaggaggtgtatcacggcatgttccgcgtttactcggtgtccgatatccagaatatcgtggtctccttaggcatgggcggtgctctcattatcacggcgctggcgctgatgaccatctgggtgtccttcagcaccaagcgggtgacggagcgcaagacaagggacttttaccggatactggacgtaatggagagcgcccgggacggagatttggagcggattcacattgacagcgacaatgaatttaagaccattgcggacgcttacaatgagatgattaccagcttaaagcttcagatggagaacaaccggaaaatgacggagctggtggcagcctcccagatcaaacagctggagagtcagtttaatccccatttcctgtataacacgctggaaaatatccgctacatgtgccgcatcgagccggaaatcgcggcaaagatggtattcagcctttccagcctgctgcgctacagcctggacgggagccgcgaggaggtgaccctgcgggaggatctggatcacctggagaattacctgacgattttgaaataccggtttaaccggcgtttttcctatgagattgacgtggaaccccaggcgcttgcatgccggatccccaagctggtcctgcagcccatgatcgagaattccgtgaaatacggcttcggcaaccaggaaacgctgcgggtggagctgaaggtttatattcacgagggcaggctgaccatgatctgccgggacgacggcgtcggaatgacgccccagacactgagcgagctgacggccctgctggggcagaaggagaaccgcagcagacattcgggactttataacatacaccgccggatcgaaattttgtacggcaggccgtacggcgtggagatccgcagcacggaaggccacggcaccacgctgatcgtgacgcttccggccaatacggaggaaaaggaatgctgagagtgttgattgcagaggatgaagatattatccgcaaaggtttggtttacacgacggactggctgtccatggactgcgtggtggtcgcggaggcggccaacgggcaggaggggctggagaagattctggagtgcaggcccgacgtggtgattgcggatatctgcatgccgtttctggacgggatcgagatgatcaagcgggcgtcggagacggtgcattttaaaagtattttgctgaccagctatgcggattttgagtatgccaggcgggccattgacgccagagtgtgcgaatatctgctgaaaccggtggatgaggaacagctggcggagattatgaagaagctgggggaagagatcgccagcagccgtcaggtggagaaggtcatggagcaggccgagctggacgggggaaatatgaacttggagtattttatgcagctggatttatcggagaaccaatatgtttccagggccatcgggcagatccgggagcgttttggggaaaagctgagtattgagtcgatttcagaggagatgggggtcagcgccagctatctgagccggaagttcaaggaggttacggggcagacatttctggattttctgaacaaataccgggtgcagcaggcgattgtgatgctcaacgcacagaagtaccggatcagtgagatttcggaggcgtgcgggtttacggattataagcatttttgtgcggtgtttaagaagtatacgttgaagtcgcctacgaagtttgtgaagggggtttagggggaggtgcaaccggtcgtgagagaaagcgggcaggggcgcactggctccggggctccgcgatggcagggagtaaggcggaagggggacggaaagcgcaggaccgctccgagctacggcgcaggcctgatgcctgcccctccgcctccgctttgttccgggcgttgaacgctccggaacaacctccgctttccgccccccttccgcctaactccctgcgaatcgctacacagtcgcctgtgcacccctgcccgctttctctcacccgcgggggaccgggcggggagagatggaaaaaattttgaatttatttgagggctgcggtgcgggggcatcgggctttttttggttgaaagagcgggaaaatgggattgtctcttattttatgcgtggggttgtcttgacttatggggggatatcaactacaatttaaaaacgaaatgcagtatgcagataaggacgggaccgtatgggaatcgtaaaggcttcgaagctgatttttgaatatatccgcagggatgaggaagagaacgtagaggaagtgaagcgggctatcaatgatgtggacgtggatattaagaagggggactttgtggctgttttggggcacaatggctccgggaagtctacgtttgcgaagcatattaacgggattttgatgccctctgagggcacggtctgggtttcggggatggataccagggacgaggagcatatctgggatgtgcgcaaagccgcgggtatggtgttccagaacccggataaccagattatcggcaatgtggtggaggaggacgtgggattcggcccggagaatatgggcattcccacggaggaaatctggcgcagggtggatgagagcctggaggctgtggggatgacggcttaccggctgcagtccccgaataagctatccggcgggcagaagcagcgggtggcgatcgccggggtgatggcgatgcggcctcagtgcattatattggacgaaccgacggctatgctggaccccaatgggcgcaaggaagtgatccgtaccctgagggaattgaaccgtgtggagaagattacggtgctgttgattacccattatatggaagaagcggtgcacgcggaccggatcatcgtgatggatgatgggaggatcgtgatggacggcaagcccagggagattttttcgcgggtgaaggagttaaagagccacggactggacgttccgcaggccacggagctggcctgggagctgaaggaggcgggtatgccccttggggacggtattttgggccgcagggagctggtggagcagttggttccgcttctgaagaagcagggagagtaaaatgtcgatcaaagcagtggatttgaattttgtgtacggcgccggaacggcgtttgagcagaaggcgctgaaacatgtcaatttcgagatacaggacggggagtttgtggggctgatcggccacaccgggtcagggaagtccacgctgattcagcacttaaacgggctggagcgggcgaccagcggccagattctgtacaatggggaagatatttacgcggaaggatatgatatgaaagggctgcgcagcaaggtaggcctggtgttccagtaccccgagcatcagctgtttgaggtggacgttctgacggacgtgtgctttggcccgaagaatcaggggctttccgcagaggaggccggggagcgggcgaagaaggcgctggagctggtggggcttgacgagtccttttacgcccagtcgccctttgaactgtccggcggacagaaacgccgggtggccatcgccggagtgctggccatggagccggaggtgctgatactggacgagccaacggccggcctggaccccaggggacgggatgagattctggatcagatcgaccggctgcatcgggaccgggggatgacgatcatcctggtttcccacagcatggaggacgtggcgcgctacgccgaccggctgatggtgatgaatcacggcgagaaggtatttgacgggccgcccaaggaggtgttccgtcattaccgggaactggaggccatcgggctggctgcgcctcagatcacatatctggtgcacgatctgcgggaacgcggaatcgacatcgatgaggatatcaccacggtggctgaggccaggaaggcaattctgaagctttacagacaataggagcggaaatgttaagagagattacgctgggacaatattatccggtagattctgcggttcaccgcctggaccccagaaccaaactgtttgggacaatggtattcattatctcgctttttatggcggacagcctgtgggcgtacctgctggccacggtggttttaggcctggtgatccgggcgtccagggtgccatttaagtttatggtgcgggggctgcgggcggtgctggtgctgctgctcatcagcgtcagctttaacctgtttttgaccgacggcactgtaattgtaaaattctggattttcaagatcacccacgagggcgtgcggctggctggatttatggcgctgcgcctgatctatctggtgatcggctcctcggtgatgacgctgaccaccacgcccaaccagctgacggacggtctggagaaaagcctgggatttctgaacaaagttggggttccggtgcacgaggtgtccatgatgatgtccatcgcgctgcggttcattcccattctggtggaggagacggacaagatcatgaaggcgcagatggcaaggggggcggactttgagtccgggaatctgatcaggaaggcgaaagccatggtgccgctgttggtgccgctgtttatttccgccttccgccgggccacggatctggccatggccatggaggcgcgctgctaccgcggcggagagggcaggaccaagatgaagcccctgcgctaccggacggcggacgggatcgcctacctgctgtatgcagtgtacattggagccatggtggggatacgggtggcgctgtagggcaggcggcccctggaggcggagatggcttgtggtgcatggggcgtgggtggcgcggcttcgggcccggcgcggtacggtctctcatcgcggcggcgcatttaatatggaaaggattggaatcatgagacggattcgtctggtggtggcctacgacggcaccaactaccacggctggcagtaccagcccaacgcggtgacaatcgaggaggtgctgaacagggcgctgacagagctgctgggggaaaatatcgcggtgatcggagccagccgcacggacgcgggggtgcacgcccggggaaatgtggcggtgttcgacacggagaaccccatggcggcggacaggatctgcctggctgtgaatcagcggctgcccgaggacatccgggtgctgagctccgggcaggtggcgccggactggcatcccagaaagcagcgctgcatcaagacctacgagtacaagattttgaaccgcaggattgagatgccggacaagcgcctgtacacgtatttctgctattacaatctggatttggagaaaatgcgccgggcagcggaatttttcctgggagagcacgattttaagagcttctgcagcgccaagacccaggtgacggggacggtgcggaccgtctatgatctgacgttggagcgggaccgggaggacgtgatcaccatccgcatcaccggcagcggatttctctacaacatggtgcggatcattgcagggacgctgttgtgggccggcacgggtctcatccggccggagcaggtggaggagattctggcggcctgtgaccgccgggccgcgggccccacggcgccggccaagggactgacgctgatcgggatgcattatccggacgaggagacagaggcggcgggaaggccgtaagcgcatacctgtttttggtatcagacattaaaaatggcgtcaactaacccaaaatgaaagctgctgcattgagaggtgcaacagctttttatgcgcctgcggattattttgggctgttcacgccgggacaattatgtggtaatataaggttatcgattttgttttgggcgggccggcacggatcaatcgaacagggtgggaggtaacggggatgaatggcgaaaagagtataccgggtaagctgtatcataaaatggttgcggtgaatatgctgaccagcctgattccccttgtgctgttttccatattttcactttacaccttcaataacaactatctgcggctcataagcaggcaatattcagatgccattgagacttcatcgacgatccttgggtattatctggattcattttacaacattgtcaagctgaatatcgatggtaacgaggatgtaagcgtccggactctggaaaccatcttcagtgagcccatggaggaagacgcgcgcagacagcagatagaggtgctgttggaggagctttcgcaggccaatccctatatcaggtcctgcctgtttgtggaccgggagggcggcgtttattccttccacaagggcggaaaaaagctggctgatccggcgctgtttctgcgccaggtggattaccggaacaggggaaagtacggtgaagatcccttcctggcgccggtccatgaaaccgcatattttacaggggagatggaggctgcgctgtccgtgggcaaggtatatgagacgcccgaaatggagggaacgctgtatatcgaggtgaacccggacgcgctgaatgtggtgttctccgataagcaactgtacggaaagggatacctgaaaatactggacagcagaggcagcaccgtgtaccagagggagcaggatctggaccgccgtgcagccagcatcgccgccaatttaagacagctcgtgttctccatggatgtgccgggtaaggacctgaccctctctttttctattgacaaggtgacggttatggccgacgtctatgtgctgcgcggcctgatgattctgatgattctctgctgcgtgaccctggtcttgatcgtttccttccgcttttcacgtcagatgaccagccccatcaaccgcatgatggagaagatggagctgcttaaaaagggtgatttctcagggcgtcttcctgtggagagcaacgacgagatcggcgtgctgtcccggcatttcaatgatatgtcggagcaactgcagcttcacatcaaccagtcctatcttgcccagatcaaagagaaggaggcggaactgaacgccctgaaaacccagatctatccgcatttcctctacaataccctggaggtgatccgcatgacggcctttgagcaggacgaccagaaggtcgcggatatgatcgaagccctgtccagccagatgcgctacattatcggaaccgcacaggatgtggttcccctcaagatggaggtggagctgcttgacaaatttatctggctgatcaattgcaggtatgagggaaaggtcagctttgagacggatatggacggattcggagcgtgcatgatccccaaaatgattttgcagcccattgtggagaacgcatttttccacgggcttaagccaaaggatgggaacggcgtgatcgaacttctggcggaggagtcggaaggcgacttgagcatcacgatcatggacaatggcgttggaatgttggagtcggaaaagggcaggatggaagagctgctttcaagcgaccggcccggcaataaggaagagtacaactggcagagtgtgggcctgaaaaatgtccacgaccgggtgagatacctgtacggccctcagtacggactgacatttgtcagccatgagggggtcgggaccgctgtcagtgtgaaaataccaaagaatctggaggggcgttaaatgtggacaatgatcatagcagacgatgagccgctgattacccggggaattcagaagatgatagattggaagaaaataggaatcgagatcgtgggatgctgcacagacgggaacagcgccctggtggagattgccaaaaagcggccggatattgcgattctggacatttccatgccggggaaaacgggattggacatactgaaggagttaaattgcatgggaattgccaccagggtgatctttatcagcggcttccagcagtttgattacgcggtggaggcgctgcgcctgggcgcggtcaactatctcttaaagccggttaataagaatgatctgattgaaaacgtcaaatcgtgcctggatatgggcgaacagaaggaacaggagccgcagagggaggaaccgcaggcggactatgaatcgctggtccagttggaggcggccatgtatgtgcccgccgcggtatccctgctgttaaattcccctcggaccaaggcagagctgcgtctgatgaaattctcgctctatcacgcgctggaggcatatgtgcaggacaatgggctgggtattgtattttacaaggacaaacagccctgtgtggtatttaagaacaaaagtgtgaatgagttatacggaatgtgcggcgggatgatccgggagattgaagaaaagacagggaaccgcctgggtgtggtattgggcagggaggtttccgagatgtccggtatccagggagcttacagcgaggcctcccggatgatggactacttttattttgagtcccttctccagatgccggtgctgagcgtggggcggccggtgtttaaaagcggatatacctatgcggatatgaaggagagcaggcagaagctgatggaggccgccctggatatggacgaggaccggattaagcggggatttagtcattacaggcgtattgtggggcagattgcggacggagataaggagacggcggtattcaatcttctgactgtaattcacgccctggaggaacgtctggaccagatgggaatatccacggagaagatggacagcgggcagatgatcaccaaggcgttggagtgcgtgaactacgatgccatgtgccaggcggcctgcggctttctcatggaatatatccagatcatgcacaatgtgctccagaaaaatgaaaagaaggatattatccgggcaaaggcatatatcgacgaccactacatggaaagcctgaccctggacgtgatggccgagtatgtgcacatgaacgcgtcctatttcagcagctattttaagcgccatacgggacagaattttaaggagtatttaaaccagatccgcctgcgccacgctctggatcttctgctgtccaccgatatgaaaagctacgagatatcggacgcggttggattcaaggatcccaaatatctgtccgaactgtttcagagaacctacgggaaaactcctgtggcttacaggaaagagctgcgcagccggtgacgggaatcgtgccatgtaatcaaacacaccctagctccgcgaaaaagcgcagggcctttgctatgccgtcctgattgttggaggcggtcacggcaaaggccgcctgtttgactgaggggaaggcgttgcccatggcgaagccgtacccggctgtctttatcatgtcgatatcattttcgccgtccccaaacactgcaacttcgctggtctgtatgccggtctcttccataatgcgctttaaggcttctcccttgctgaccccggtcgggatgatttccagccagttgggcttcacaagaagggctttaaggccgggggccagtctgtcacgtatcagggggaggacttcctgcagcctgacagagctgtgcagcagggcgattttgttcacctcccgcgggaatggggcctcccaggatgtgatgggccttttctcacctaagatggattcgtgatccttataagccgcggcttggcgtcccctgagccaggcttctttttttgcctgaaaatccggaggcaggtactggtagcgcacattgccatcatagcagagggcttccaggcagtaatcatttgcaagctttaataccggggacacatcggcggcaggcaccctggggccgcgccatatgtgtccgtcggaaaaacggcagatctcttggccgttcagggcaatgatataattatccttaaaacgctccatctgaagctgttcctgctcccgggcggtgaatcttggggagcgcccggtggcgatgaccatgcggattccattttcctgggcatggatcaacgcgtttttggtagcaggcgtgatcacgccatcatcattcagcagcgttccgtccaggtcggcggctatcatttttatcattcttttacactccttcgtcttgcgtcggttaaacgtgttttgtatagctacattatacgatagaatgggccggacaaagaacgcggtttttttagatgtttggggtcactttttagggattggcccggggcggaggtcacagaaaacaaatccaaaaaaacacccctttttcctaaaagaaacatattttttttaggaaaattttatattatgatgtttttaacaaaacaaaccaaccaaaaaagaaggggcagatatgagaaaagtaattttgatatcccacggaaagctctccgaaggaatggcctattccgcgcagatggttgctggggaaaagaataacctgtcttattacgggctgatgccgggggagctggtggaggatatgatggctgagatccggaccaggattgaggctgatccggataaccagtatctggttgtgtccgatgtgtttggcgggagcgtgtgcaacggttccatagcgcttcagaatcttcccaatgtaaagctggcgaccggaatgaatttgctgttggtgatccaacttctgttctcagacagtgaaatgacagaccgcgagtttgaggagctggttgcatcgtcggtcgacactgtgaaggtgattcccaaggtgactgccgtgggcggaaatgatgcggaggatttcttttgagccgtgggcggtacagtaccaccgcctgggagggagagacatgaggcagataaaaaaagaaccgctggattccagatatgagaacggcgcattgttgacagccgggtgggtcgatcaggcaatcggcgaagccagagcgcggatcgaccggttgctgccaagattttccgatacatttcccggcgccagcacggtgcacggcaggtatcagccggtggaaaaagtggactggacggagggattctggaccgggatgctgtggctgctctatgaggcggccggggatgcaaagtaccgcgaggcggcagagcgttttctgccaaagttcagggagaggctggatcggaagatcaaggtaaatacccacgatctgggattcctttattctctgtcctgtgtttccgcctgtcggctcaccggcaatgaggccgcgcggcagacggctctggccgcggcagagattctgtatgaccgttacaatgagacggccggaattatccaggcatggggagatctgaatgatccgacaaagcaggggcggatgattatagactgcaacctaaacctgccgcttctgttctgggccggaggtgagaccggcagggaagcttatattcacgcggcaagaacacatctggaccgcgccatggaatacctggtaagggaggatgcctccacgtaccatacatattttatggatgtccatacgggaaaggctctcaggggcaccacccaccagggatacgcggacgactcctgctgggccagagggcaggcttgggccatactggggtttgccttaaactaccggagatacaggaacagggagctgcttgaaactgccaaaaaaaccgcctgctatttcctgaaccggctgccggaggattatgtgtgttactgggacttaatcttcgggccggaggatgggcagtacagggatacgtcggcggcagccatcgcagcttgcggcttgttggagctgctgcgggagatgccgcttgcggacccggagcgccggggcgttgaatatgctgtgtgcgccatcatggaaagtctgcggacacactacctgacccgggatgaggacggaattctccttcacggcctgtacaattacggccggggaatgggaatcgacgagagcaatctatggggggattattactatcttgaagcgcttgtccgaatgaaacaggtgtgggaaccctactggtaaacaaaaggaaaggatggaaaaggtatgattgcgttgatgagaattgataaccgcctgatacacgggcaggtggcgctggtctggacaaagcatctgggggtgaaccggatcattgtagccaacgatgatgttgtgaaaaacgaggtacaagtggccacgctgaagatggcctgcccctccagcgcgaagtgttcagtgctgactgtggaggacgccgtcagtgtgctgaacgaccccagggctcagtcattgaagatctttattgtggtcaacaaccccacggatgccagaagaatcgcggaggcggtgaaggacgtgcccaaggtaaacatttccaattacggacatctgggaaatgacctgaacagccgcacgaagatcacggacaccgtatatatcacggaacaggattttgaagaatttgcacgtatccgggacacgggtaagccctgccagtatcaggtggtgccggacaaccagcctttggatatgtatgagttgataaagaaagcaaaaaataaataaagggaggataagaaaatgattgtaaaagcttttctggtcgcacttgtgatgtttatcgccaaatttgccgatcacggctggggccagcccttgatcgagcgccccatatgctgcggcgccctggtggggcttgtgctgggagatttgagggagggcgttatgattggcgcgtccctggagctggtgtttcttggaactattaccatcgggggttcgctgccggccgacctggcggtgggttccgtgctggccacggcattctcgattttgctgggtcaggagcaggaagtagccattgcccttgcggtgccgatttccctgctggcgacctatgtataccaggtgtttaaactgttctgtaccaccatggtacagcgctatgaccgcctgctggaccagggcaacgacaaggctgccttgaatcagaacattgtcctgacactgatgtaccccgccatatttatggtaatcgcattttttgccattctggtgggcacaaacgccatcgaatccgtggtaaacgccatccccgaatgggttatgaccggactcaagacagcgggcaacgtacttcccgccctcggatttgcgattttgcttaaaacgctgtggaagaccaacattgcccccttcttttttatcggttttgtgtgtgccgcgtacctggggctgggcacgattccggttgcaatcatcggcgcaggtattgcggtttacatctgcctgacagattacagccatattaaggaaatgaacgcgttaaaatccagcggcgtggcggaaataacggataaggaggattttttcaatgactaaacaggttgaattaaacgaaaagaaaatgtttcgcaccatcttctggcgccagttccagctcctgggctgcatgagccacacccgcatgcagggaatcggatttggatggtccctggcccccatactgaaggaaatctatccgaaacgtgaggaatatctggaagcgctgaagcgtgagagcatgtttttcaatacgacgcaggccctggccccgttcattatgggactgaccgtgtccatggagaaggaaaatgctgaaaacccggagtttgacgtgaacaccataaacggtgtcaaggtgggccttatgggaccgtttgcaggaatcggcgatacctttttctacgcgaccctccgtgtgatcatcacctcactggtcatcggcctggctttaaacggcaatgtgatgggcccgatcctgtatgtactgctttataatatccccaactatctgctccgctatttcggctgcatctacggataccgtctgggcagcacctacataacagaggcggccaaatcgggcctgctggactgtatcacaaaggcggcctccatcatgggcctgatgatgatcggctgtatgtcctacaacatggtcagctttaagtccacactggaggtggccatggaaggcagcaaggacccctttgtcctgcagacgatcctggactccatctgtgtgggcatcgtgccgctgtgcctggtgctggcgtgctttgcagccctccgcaaaaaagtcagccccaactggtgtctggccggtctggtggcatttggattcatcgctacattccttcatcttgtgtagggcgtgggggcctgtttttttcaaaactttttcagaaagatgggagtaaggccggtttttcggcgaaaaagtggttgacatacccgggcggatgtaatataatataaaactgtgacattagcaaagaatgcttagccattgccccggagtaagcatttgaccgataaatacttcccatatttatcatgcatacagagggcgcctgaaggcgcgcatcagtagaaaaggttgaatttaacaggaggttgaccccatgaagagttttatggctagtccagcgacaatcgagagaaaatggtatgtagttgatgcgaccggatgtacattaggacgtttagcttcagaagtggctaaggtattaagaggaaagaacaaaccgacttttactccccacatggattgcggcgattacgtgatcattgtgaacgcggacaaggtgaaagtaaccggtaagaaattagatcagaagatttattacaaccactccgagtatgtgggcggaatgagagagaccacactgcgtgagatgatggctaagaagcctgagaaggttgtagagttagccgttaaaggtatgcttcccaagggaactctgggcagaagcatgtttgacaagcttcacgtatacgccggcccggatcatcagcaggcggctcagaagcccgaagttttaacattttaatgaggaatggaggaagaaaatatcatggctagcgcaaaattttacggaacaggcagaagaaaaaaatccatcgccagagtatatttagtaccgggtaccggcaacatcaccatcaacaagagaaccattgatgagtaccttggacttgagacattaaagttaatcgttcgtcagcccttagtagcgaccgagaccagcgacaagttcgacgttctggtaaacgttcgcggcggcggcttttccggacaggcgggtgcaatccgtcacggaatctccagagctctgcttcaggcggatgccgagtacagaccggtcctgaagaaagccggatacctgaccagagacccgagaatgaaagagagaaagaagtacggcttaaaggctgcacgtcgcgctccgcagttctccaagcgttaatcgcgttcaggatctacaattcgcagacacattcaaaaccttccggggatttccctggaaggtttttttgtggtgcgcccggcggcgcacgtacccgggagcggggcttgtggaccggcagaccggcgtgactgccccctccccaaacggctggaacgcccttgccgcggccgcgccgtaccggccggaagcccccctgtccgcgttcaaaacgggccacagaatattaataataatggatggattatattaagagtttggtaatattattttttcccagaaaatgtataatagaacaaacagcaccgtgatatggcggaagtggatgggaggaaatgattgtgagaatgagtcgaatgtcagcaattttgtttgccgcggttttgtcggccgcacagctgtcggcctgcggccgttacgcggagattgagaccgccgggcagacggcggatgcaacttccggggagactgcaccggaaacgggtgagagcgcggcaggagaaagcgcagcggcagagagcggtccccaggctggagaagcgccgtccgcagagcccggcacgcaggccccggttgagagcggcgccggggatggcgcccaaagtctgattccggagagcgggaattcggaggtggcggaccagggagcggatgcggaggcatttttcatgcagagcggcatgtccaaggaggaggctgcggcttttgtctccacatttctggaggccgtaaaggcggacaaccgggaggcggtggcgggaatgatccgatatccgcgccaggtcaaaacgcctgcgggcgaggcccaggtggcgggagcggaggaatttctggcgtactacgacgatatttttacacaggatttcaggaaaaaactggaagaaactccggctacggatctgttctgcaaggacggcctgatcggattgggggatgggagcgtgtggttttaccccgcaacggttgaggacgacatgagcgtcacttcggtcaatgtctccgctgaccgctatgtacgctacggcggtccctccggcgtacagcccggataaacggataaaaaataatttcatttaagtgtaacattccttcattttgcggatctaataggcagaaggaggtggcgcagatggcagcaagcgatgaggttgaggtattataccgccggtattcccaggcagtgtacggttatctgctttccatgtgcagggaccggcatgcggcggaggatattcttcagtctacttttttgcaggtgatcagggggattgcaggttttcgcggggacggctccgtgaaaacctggattttctccatcgcccgtaatgaatatttccggtggctgcgccggaatccgccgtcccttcccttagacgagtccataccggctccgacggacttggccggggattaccgggaacgggaaaagatccgggaggcgttcggttacttaaacggcctggaagaaccgctgcgaagcttgatgtgcctgcggattttcggcgggctgtccttccgggagatcgcggccctgcagggccgaaccgaagtgtgggcccgggtgaactttatgcgctgcaagaaccgtatgctggagcatttggaggaggaatgaagatggaacggaacgattgcgcgattgtgcgggatcttatacccatgtatggggaggacctgctgagtgaagagacaagagattatatgagggatcatatggagcactgcggcgaatgccgcagatacctggagcagtgcctgcgggaggtgcaggtgccggtggagccgcccgcgcaggagacggacaaaaagatcatccgcgggatgcgcttccggctgatctggtatctcttctggccgtcgctttacgcggtctgtatgcaattcggaaaagaagggacgctgagattttttggaatcgctctgattttgactgcgtggatcaccattggaacacatcattacgagtataattttgatttggacgacacaaaacgcgaattttatcagagggaagagaaaaatatcagggaacacaaaggcaccttcctgacccagggcctgttgctgtgtctgcctgtgttcattccctttgccatcggagtggccggcatgctgctgggcggttgacccgtcttttggatcaaatcatacagatagaaaaatcccccggaggaaactccgggggttttctgaaatagagtgcaaaaccatcaaaaatgggggattggcgggtgtaaaacagtggttcatatgggaatattctacaccctggagttactccaaggtcaatgcatgtaaggaaattgtaaggattttccctggagcgtgtctgaaaattcattcccgccatctgcacgccccacttcgcggcatatttggtcccgattcggtcaacgtagcccgctacgcctccctcatcgggaccaaatcttccacaaagtgggacgcacatctgacggaaagcaattttcagacacgctctaaatccatcccccgtccaggccgatgacctgaccggtcaggtaagcgtttttgtagcccagatggtagaccagatccgccacctcctcggccgagcccagacgtccggccgggatatcctccaccagggcgatgagctcgtcctcctccatccactggttcatctccgtgtcgatggcgccgcaggccacggcgttcacctggatattggagggagccagctcctttgccagtgctttggtcagcgcgttgattccgcccttggtggcggagtacgcagtctcgcaggaggcgcccaccacgccccagaccgaggacacgttgacgattttcccctgtttctggcgcaccatgtaggggatggccagcttgcagcagttaaagaccgaggtcaggttgacatggagcatccgctcccagtcctcggaggacatgtcctgtaaaagcccgatgtaggagattccggcgttgttcaccagcacgtccacgcctccgaaccggctgcggatctgggaaaataatgtttcacagctcttgagatcccccatgtcgcccagataggccaggcagggggcctgaaagctctcgatttcacgcctggtctgctccagctgctcggcccggtggacgcagctgatcaccacgttgtatcccttcttggcaaatttgatcgccacggctttgccgattcccctggaagctcctgttaccaaaacagttttgcgcggcatatactgcctcctttcagtggtattcttccaaatattgtatcccttgcagctattataaacattcgtcggaccgatttcaagtgattggcggataaagtgaactttgcggattatgaattgtaagaaaatcgggtacaacaaatggaaaccttgtgctataataatttgtagttgcataaaaacgataaaatggctgcaggaaggtatttttgctaccgcagacagaaataataacagaaaaggactgagagattatgacgagatatgatttgattattatcggttccggaccggcgggacttgcggcggcgatctatgcccagagagcgagactgaacactctggtggtggagaaagctatggtgagcggaggacaggtgttgaccacctacgaggtggacaattatcccggccttcctggtatgggcggatacgacctgggcatgaaactgcgcgagcacgcggacgctctgggcgcggtgtttgcggaggacgaggtggtccgggtggagaacgacggggagatcaagcgggtggtctgcgagcaggagacctacgaggccaaagctctgatcatcgccaccggcgctcatcaccggaagctgggagttcccggcgaggaggagctggccggggcgggcgtttcctactgcgccacctgtgacggagcgtttttccgcaacaaggtgaccgcggtggtgggcggcggcgacgtggccgtggaggacgccattttcctggccagaatgtgcaccaaggtgtatgtgatccatcgccgtgaccagctgcgggcggccaagagcctgcaggagactctgctctccctgccaaacgtggagatggtgtgggacagcgtggcggatgagatcatcggcgacggacgggtggaacagcttaaggtgaccaatgtcaagaccggcgagtcccagaatctggaagttcagggagtttttatcgccgttggcatcacgccggaaagccaggcgtttaacggactgctggagacggatcacggttatatcaaggccggggaggattgcgcgacctctgtgccgggcatctttgcggcgggagatgtgcgtaccaaacccctgcgccagattgtgactgcggcggcggatggagccaacgcggtgaccagcgcggaacactatctgatgggcaactaggaggaggagcgcgttccaatgaagaaagtggcgaaaatactcatcgccgggggcgtgtgctcggttttctgggcgatgccggccagcgcttcgacgaacctggagaccagttcctcactggcgggcatctccgtggcgctaaacaatttctacgccagcaccgaggagccggagcaggcccttgcgtctgtttttgacgcggctgccgtcacttccgcagcatccggcggcggaggtggacaagcagctcagggagggcagtccggcgagacggctgccgccactacagcggctccggagaccaccaaggccaagtcctctccctatgacaacgttgcggtgtccaaggtgaacggttatgtgaatatccgcaccgaggcgaataccaccagcggcgtgaccggcaagatctacaacgacagcgcggccaccattctggacacggtggacggagagggcggaaagtggtataagatccggtccggttccgtgaccggatacattaaagcagaatatttcgtcaccggcgcggaggctgagagcaaggccaagcaggtggggaccaggtatggtactgtggtcggcactcccaccctgcgcctgcgcaaaagcccggacctgaccagccagacgctgaccctgctggccgagggcgcccattatgtggtgctggaggagcagggggacttcctcaaggtggcggtggactcggacctggaagggtacgtgttcaaggactatatgaataccaccgtggagttccagaaagcggtttccgcggaggaggagaaagccaaagccgaggaggaggccaagcgcaagaaagaggccgaggaggccattcaaaagctggaggaggcaaaggaagcggagcggaagaaaacgaccaccgctgcggagaccacgaaaaaggagaccaccacggcggccacgaccaagtccaacggcaacacggcggacggcactattccggtgaatccggagcagggcggaggggagagcgcggcagcgcccaccacggccaaggaaacgaccacgtccaaacccaaggagaccacaatcgccgtggggccgggcggcggaggaagctccggcgaggtgacctcggccacgcgcacggccattgtggcttacgccagacagttcttaggcaacccctatgtctacggcggcaccagcctcacaagcggcgcggactgctcgggctttgtcatgagcgtgtacgcccatttcgggatcagcacgggaagaagctccagagaccaggcggccaagggaaggaccatcccgaccagcgaggtgaaacccggagacctgctgttctatgccagcggggattatatcaaccatgtggcgatctacataggcggaggacaggtgattcacgccagcacgcccgctaccgggatctgcctggctccggccaactaccggacgccgtgcaaggcggttacattcctggattaaggcggccggaacggtttttgcagtccggcggctgtgttaaaaaaataatgcgagggggaccggaagggtccctctcttattgagtgcaatgggccgcaggctgggccagcggctcattgcagactaccgtgaaccggagggcgggtctttggacctgccgtgcggccgcgtgaaagaggttttagtatggaagagacattgaaacaggaagatttgagggagaaaatgatccgggaccggcataagggcatcgcgtgcatcgtgctgtccgcgctttgctttgcctttatgaacgtatttatccgggccgccggggacctgccgtccctgcagaaggtatttttccgcaacctgatcgcgttttttgcggcctggtttgtgatgcgccgcaagcatgtagcattttccgggaagaagtccaatctgctgctgctcgtctgccggtccatgttcggcctggtgggaatgatgggcaatttttatgcagtggaccacctggtgctggcggacgcttccatgctgaacaagatgtccccattttttgccattttgttcagtatgctgattttgaaggagagtttgtcgtttaagcaggcagcagcggtggtgggcgcattcgcgggaagcctgctgatcatcaagcccaccggttttgacatacagagtcccgctgcggtggtgggccttctgggagggatgggcgccgggatcgcctacacctttgtgcggattctgggaaagcggggagaggcagggccctttatcgtgtgctttttctccggtttttccacgctgatgctgttgccggtatttattctcaactatcacccaatgacggcctggcagctgggcagcctgctgatggcgggcgtggcggcgaccggaggacagttcggcataacggcggcctattgctatgcgccggctcgggacatctcggtttacgactactcgcagatcgtcttttccgcgattctgggatttttcctgttcggccagctgccggatgtgtacagctggatgggatacggggtgatctgcgccatggcggtgtggatgttctttatggagcggaacggcggggcgaaggcccgggcgtgagagcgggagctttggggcggaccgcgggattatgggcaaagattaaggaggggcgtccggcccctccttattgtatttatgaaaatgtttaaaactccggttcaatcagtccgtaagtgccgttcttacgcttgtacaccacgttcacctggtcggtatcggaattgaggaatacgtagaaattgtgtcccagcatctccatctgcaggcaggcttcctcgggaatcgtgggtttgattgcgaattttttggtcttgacgatacggatatcgtcctcctgctcgtcctcttcctcgtcgataaacgcctgggagaaggagagagcggcctgtttcttgtcaatcagtttctttctataacgtctgatctggcgttcaatcacctcttccaccaaatcgatggagacatacatatcggtgctggactcctcggcgcggatggtgttgcccttgacgggaatcgtcacctcgatcttctgccggtctttctgtgcgctgagcgctacaatcacttcggtgtccggtgtgaagaagtgttccaattttccgatcttcttttcgacggcggccttcaaacctggagttacctcaatatttcgtcctgttatggtataacgcatacaatcaactccttttcttgagatagggtaattatatcatatttattccgaaaatacaatcgaattcaataaaatgttaggacaatttgtcttaattttttctaaaaatgcgctttgggcgggcgaagcgcctattgaattcctattagaagtgttcccgaaatgtcaagagaaatgcttgtatttaattttgaaattgttaagtttatgagaactgtacaaaaattaagattccgctaaccgacaggggggaaaggagaaaaacaggtcgaaaattgtggataatgtggacaactcggtgcataactcgattttcacgtaaaatggaggattccgggtggggataaaaatggggaatctgtgtgtggataactgtggagagtgtggataagtcgggggacgaacatacattttgtgcaatgtgcttggttgacaataagttctcaatgtggggggcgtccggggggcatttgccccttaaacggggcggccggaaaacctggaaacccttgatattactgggaaaagtgtgaccaaaatgttaattttgtattaacttgttgaataaattccggcttagtgctacaataagtaagattgtatcgtaggcgcagcagctgcatccatgtaaagccaaggaataagcgggactgagatgacaaatactagaaattattgagaagcagtgtggatgtgccggttggaaatgtattttatataaggaagaagttaggagagtataccatgaacgtaattgagaaagtgttcgggactcacagtgagagagagctgaagctgatcaggcctatcgtagcgaagattgaaagcctgcgcccggagatggtggcaaagtccgacgaggaactgcgcgaccagaccaggatttttaaggagcggctggaaaagggagctaccctggacgatattttgcctgaggcgtttgccactgtccgtgaggcggcaagaagaacgctgaatatggagcatttccccgtgcagctgatcggcggtattgtactgcatcagggacgtatcgcagagatgcgtacaggtgaaggtaagacgttggtatccacctgtcccgcatatctgaatgcgctggcgggaaaaggcgtacagatcgttacggtcaatgactatctggcaaagcgtgacgcggagtggatgggacaggttcaccagttcctgggactgaccgtgggcgtggttttaaatgatatgaattccgatgaccgcagaaaggcttatgcctgcgacatcacctatgtaaccaacaacgagctgggattcgattacctgcgcgacaacatgtctatttacaaggagcagctggttctgcgggatctggactactgcatcatcgacgaggttgactccgttctgatcgacgaggcgagaacgcccctgatcatttccgggcagagcggcaagtccactaagctgtacgaggtctgcgacattctggcccgccagctggagaagggcaccgtttccaaggagttctccaagatcgacgccattatgggtgaggatgtggaggagaccggcgacttcgtggtggatgagaaggataaggtggttaacctgaccgaggacggcgtgaagaaggtggaggatttcttccacatcgagaacctggccgacccggagaacctggagatccagcacaatattattctggctctgcgcgccaactacctgatgttccgcgacaaggactatgtggtgaaggacggcgaggttctgatcgtcgacgagttcaccggccgtattatgccgggccgccgctattccgatggtctgcaccaggccatcgaggccaaggagcacgtgagcgtgcgccgcgagagccgcactctggccaccatcaccttccagaacttctttaacaagttcaagaagaaagcgggtatgaccggtaccgcccagactgaggagaaggagttccgcaacatctactccatggacgttatcaccatcccaaccaaccgtcccatgatccgtaaggatatggaggacgcggtttacaagaccaagaaagagaagtacaaagccgttgtggagtccgtgcaggaagcctacgacaagggacagccggttctggtgggcaccatcgccatcgagacctccgagctgctcagcaacatgctgcgcaagcgcgggattccccataaagtactgaacgccaagttccacgagctggaggctgagatcgtggcggatgccggtatccacggcgccgtgaccatcgccaccaacatggccggccgtggtacggatatcaagctggacgacgaggccaaggagctgggcggattaaagatcatcggcaccgagcgccatgagtcccgccgtatcgacaaccagctgcgcggacgttccggacgtcagggagacccgggtgaatcccgtttctacctgtccctggaggacgatctgctgcgcctgttcggctcagaccgtctgatgaagatgttcgaggccatgggcgtgcccgagggcgagcagattgagcacaagatgctctccaacgccatcgagaaggcccagatgaagatcgagagcaacaactacggcatccgtgagcagctgctcaagtatgacgaggtgaacaacgagcagcgcgaggtgatttatcaggagcgccgcaaggttctggacggcgacaacatgcgcgatctggttctgaagatgatcaccgacatcgtggagaacgccgtggatatgtccatctccgacgagcagactcccgagaactgggatctgaaggaattaaataccctgcttctgcctgtgattccgttaaagcccatcacgctgacggaagagcgcaagaagatgaagaaaaacgagttgaagcacatgctcaaggaagaggccatcaagctgtacgagaccaaggaggccgagttcccggaaccggagcagatccgcgagatcgagcgtgtggtgcttttgaaggtcatcgacaacaagtggatggctcatctggacgacatggaccagctgcgcgagggcatcggcctgcaggcttacggccagcgcgatccggcggttgagtataagatgcagggctatgagatgtacgaggccatgatggcttccatccaggaggaaaccgtgcgcatcctgttccacattcgcgtggagcagaaggtggagcgcgagcccgccgccaaggtgaccggcaccaacaaggacgattcctctcccagcgcgcccaagaagcgcgccgagcagaagatttaccccaatgatccctgcccctgcggttccggcaagaagtataagcagtgccacggaagaatcaaataaaagggatttttttccagatagaaaaggccggtatgcattggcatttaccggccttttaaaataaggcggcccaaaccggccccacaaattaaattttatgaaagaaggtgaagctgtggttgagttagataattttaagtatacgttgtcaacgtatgacaaaccattagtggaagtgagggattcactttgacctggacaacaaggtcagacgaatcgctgaattagacaaatccatggaggagccgggcttttgggacgaccccgagaaatccacgcgtatggtccgcgaggccaagaacttaaaggacgacgtggagacttaccgggagctggaacaggagtacgacgacatccaggtgatgatccagatgggctacgaggagaacgacgcttccgtgatcccggatatccaggaaatgctggatcattttatcaaaacgctggaggatatgcgcttaaagctactcttgtccggcgagtacgacaagaacaacgccattctgcgcctgaacgcgggcgcgggcggcacggaatcctgcgactggtgcagcatgctctaccgcatgtactgccgctgggcggagcggaagggcttcaagtacgaggtgctggacttcttagacggcgatgaggcgggcatcaagtccgtcaccatccaggtgaacggggagaacgcctacggctatctgcgctctgagcacggcgtacaccgcctggttcgcatctcgcccttcaacgcggcgggtaagcgccagacttcctttgtgtcctgcgacgtgatgcccgacatcgaggcggatctggacgtggaggtcaacccggacgatatccgcgtggatacctaccgttccagcggcgcgggcggccagcacatcaacaagacctcctcggccatccgcatcacccacatgcccaccggtattgtggtgacctgccagaacgagcggtcccagttccagaacaaggataaggccatgcagatgctgaaggccaagctgtatatgctcaaacggcaggagagcgcggccaaggctgcaggcatccgcggcgaggtgaaggacatcggctgggggaaccagatccgttcctacgtgctccagccctacaccatggtcaaggaccaccggaccggtgaggagagcggtaatgtggacgcggtgctggacggaagcatcgactccttcatcagcgcctacctgcgctggatgagcctgggctgtcccaacaagaacgcgtcggttgacgactgacaagcgcgacttcaatacgcgagataaaccgtttgccgcggcatccggccccttttggggacggggccgcggtattttgaatgggagggccgtccgggggacagtggtggccgcgccattccctggacgtgcgcttttgcgcgtacacgctcataaaaatgaaaaatcagttgcattttcatgggaaatgtgctaacatcttccacatgagtacagatgtatttctaatgcggacatatggacggaggcagttcacaggccgccggagatcagatttcgtgaaaggacgtatatggaggacaagagtaaatactttgtagtaaaacagaaggcggtgccggaagtgcttttaaaggtggttgaggccaaaaagctgctggaatcagagcgcgcgatcacggtgcaggaggccaccgacaaggtgggcatcagccgcagctcgttttataagtacaaggacgacattttcccgttctacgacaacaccaagggaaagacgatcactctggtggtccagatggacgacgagcagggactgctcagcgacctgctgcacgtggtggcggtctacaaggccaacatcttgaccatccaccagagtatcccggtcaacggcgtggccacgctgaccctcagcgtggaggttcgggagaacacgggaaatgtgtccagcatggtggaggagctggaggagctggacggcatccactatgtgaagatactggccagggagtgagagacggcctttcagggccggtatgattttgccgcaaaaggcggctggacgggcagggactgcctcatttaatcaacgacagggagtgtgtggacatgataaaagtagcggtaatgggatatgggaccatcggttccggcgtggcggagatattggatcagaaccgggatgtgatcgccgggcaggcagggcaggatgtggaattgaagtatgttctggatctgcgggatttcccggacagtccggtggcggataagattgtccacgattttaaggtgattgagcaggacggggaagttgagatcgtggtggagaccatgggcgggctgaatccggcctaccccttcgtgaaagcctgcctggaggccggcaagcatgtggtcacctccaacaaggcgctggtagccgcctatggcacagagcttttacagattgcccgggacaaaaacgtgaatttcttttttgaggccagcgtgggcggcggtatccccatcatccggcccctgtaccgctgcctgatgggcgagcgcatcgaggagatcaccggcatcttaaacggcaccaccaacttcatcctgaccaagatggataaggagggagcttcctttgagggcgcgctgaaggaggcccagaacctgggctacgcggagcgcaacccggaggcggacgtggagggacacgacacctgccgcaagatcgccattctcaccgctatggccacgggccgggaggtgaatttcgaggatatctacacggaagggatcacgaagatcacggacgtggacttcaaatatgcggagaaaatggggacctctgtgaagctgttcggtaccagccgcataagcggcggcagggtcagcgcctttgtggcgccggtgatgatcggcaaggaccatccgctgtacgcggtaaacgacgtgtacaacggcatcatggtgcgcggtaatatgctgggaacgtccatgttctacggcagcggcgcgggcaagctgcctaccgccagcgcggtgatcgcggacatcatcgaggcggctcagaacatgaagcggaatgtccgcctgggctggacgtctgagcgccaggccgtggagccgatggaccgggtttccttccggtattttatccgcatggcgggcacctaccgcaacaaggagcaggacgtacgcgccgccttcggaccggtggaggtggtggagctctacggaatggacgaatttgccgtgctcacccgggagatgaccgagggcgaaatgaaagccgcggtttccggctacaacgccgcagaggccaagcgctcggagtatggcgtcaagcagacgatccgggccatggtctgagacttgcgtccggagtggagtgagcgaattgaaaacgatcatacgatttgttgaattgatggcagggcaggggtttccctgcctgttccatcttatgacgggactttactgccccggctgcggcggaacccgggcggtccgggcgctgctcaggggcgatctggccatgagcttccagtatcacccgctggtgctctacatggcggcggtgattctggccgaggcggtgagcttcgggatcgccagggcgacaaaaaaccccagatggtttctggggcatgtgcttggctttgtttatatcggggtggggatcatcctggccaactggatgttcaaaaactatatgctggtgttccgggggattgacctgataccgctgtggacatactagacaatcttgtccggcaccccttagggcatcggcagggaatccataggcacgccgtaaacctgctcgaacacctgcttgaactgtttgatcatctcgctgagatagggccatttctccggctcgcggatggcgctgtagtatgcgatcatggcgtagcagacaaagaaggtcagggccacggccaccgcgcagagcaccaggccgatgacggcgtgggtgcagaaggatttcttggggcggatatccgcgttccgggacatgatggccatgacgatgccgatggcgccgcagatcagaccgctggggaaacagcagcaggcgcagagcacgcccacgatgccggccaccatggaacagatggcaaggcgctcggaggaatcgccgggctgggagtttttcggctgtttctggtcggaagcgatatatttattctgaagatccggtttttcattcataatgtatgctggttgcctttcctggtgattgaacggtaaaaatgctatcttggctattctatcacgaaaattgcaggctgtccagacggggaatgaagggaatatccagccgttactgttcaccggtattatcctgcgaggcgttttttgtgagtggagcgcagcggaagtcacagaaaacccggccaggcgcgtttccgggcgcggagtgaaccgtaagaatgttgacaaacaggggaattcaggatatatttggagctgtgagtttgacagaagccgtatcaataagaggaagagcaaatggatattattaagacactggcagaagaactgaaaatcggccgcggccaggtggaagcgactgtaaaattaattgacgaggggaataccatcccctttatcgcacgttaccgcaaggaagtgaccggttccttaaacgacgaagtgctgcgtgatctggacgagcgtctgcgttatctgcgcaacctggaggaccgcaaggagcaggtgatcgcctccatccgcgaccaggaaaaactgaccccggagctggaacagcagattcgcgcggccgccaccctggtggcggtggaggatctgtaccgcccctacaagcccaaacgccgcaccagggccaccattgccaaagagaaggggttggagccgctggcggacctgattttcatgcagatggcgaaggaaccccttgaaaaggcggcggccccgtacatttcccaggaaaagggcgtggagacggtggaggaggccataagcggcgcaaaggatatcctggcggagcgggtgtccgacaacgcacagtaccgcacttacatccgcagcgccaccatgcgggagggaacgctccagtccacagctaaggatgaaaaagcccagacggtctatgagacctactacaactacgaggagcccatccggaaggcggcgggccaccgggtgctggcgttaaaccgcggcgagaacgagaaggcgctggcggtgaaggtgacggctccggaggaaaccattctgcgctaccttgaaaagcaggtgatcgtgcgggaaaatccctacaccacgcccgcgctgaaagcggtggtgcaggacagctacgagcgcctgatcgccccttccattgagcgcgaggtgcgaaacgagctgacggagaaggccgaggagggcgccatcaaggtgttcggcaagaacttagagcagctgctcatgcagcctcccattgtgggccgcgtggtgctgggctgggatccggcgttccgcaccggctgcaagctggcggtggtggacggcacgggtaaggtgctggacaccgtggtgatctaccctaccgcgccccagaaccgggtggaggaatccaaaaagattttaaagaacctgatcaaaaaatataacgtttccctgatctccgtaggcaacggcacggcgtcccgggaatccgaacagatcatcgtggacctgctgaaggagatcaaagagcaggtgcagtatgtgatcgtcaacgaggcgggagcctccgtgtactcggccagcaagctggctaccgaggagttcccgcagtacgacgtggggcagaggagcgccgtgtccatcgccagaagactgcaggacccgctgtccgagctggtgaagatcgaccccaagtccatcggagtgggccagtatcagcacgacatgaaccagaagcgcctgggcgaggccctgggaggcgtggtggaggactgcgtgaacagagtgggtgtggacttaaacacggcctccgcctctttgcttgagtatatttccggcatcagcaaggccctggcgaagaatatcgtggcctaccgggaggagaacggagcgttttccaaccgcaggcagctgcttaaggtggccaagctgggccccaaggcctttgagcagtgcgcgggctttatgcgtattctgggcggggagaatcccctggacgctaccagcgtgcacccggagagctacaaggccgcgggtgcgcttttggaaaagctgggttacaagccggaggagctgaaggccggggggctctcgggaatccgcggcaaggtgcgggattaccggaaaatgtccgaagagctgggcgtgggagagattaccctccgggatattgtgagcgagctggagaagccggcccgggatccaagggacgagatgccaagaccgattctgaggaccgatgtgatggatatgaaggatttaaagccgggaatggtgcttaagggcacggtgcgcaacgtcatcgacttcggcgcctttgtggacatcggcgtacaccaggacggtctggtacacatttcccagatgacggaccgctacatcaagcaccccctggaagccgtcagcgtgggtgacgtggtggatgtgaaggtgctgggtgtggatctggccaagaaccggatctccctgacgatgaaagggctgaaataatggtatatgagtcgaatacgccccaggagacctttgagctggggaaaaggctggcagaggcggcgaagcccggccaggtgtactgcctggacggggatctgggcgtgggcaaaaccgtgttcacccagggatttgcccggggccttggcatcacggggccggtgaacagccccactttcaccattgtgcagcagtacgaagaagggcggctgcccctgtaccattttgacgtgtaccgcatcggcgacatcagcgagatggacgagatcggctatgaggactgcttttacgggagcggggtcagcctgatcgagtggtcggaactgattgaggagcttctgccggaacgcgcggtgcatgtgaccattgaaaaggatctggagcggggctttgactaccgcaggatccgggtggagggactggaatgagaatactgggaatcgagagttcgtccctggtggccagcgtggccctggtgacggacgatatactgacggcggagtacacggtggacttcaaaaagacccactcgcagacgctgctgcccatgctggaagagatcatgaacatgctgagtctggaaatggacacggtggacgccatcgccgtggccggaggtcccggctcctttaccgggctgcgcatcggagccgccaccgccaaggggctggggctggcgcttgacaagccgctgatccatgtgcccacggtggacgcaatggcctggaacatgtggggcgcggcaggccttgtctgccccatcatggacgccaaacggcggcaggtgtacactggcctgtaccggatggaaaacggcatccaggtgattaaaaagcagtgcgcaatggacgcgggcgagctggccgcagagttaaacggcatgggcctgccggtgatctttttgggggatggggttccggtgtaccgggagctgtttgaagagtcgctcacagtgccctttaagttcgcgcccgcccagatgaaccgccagagaggcgcctgcgtggcggcgctggggatgttggtcatgacggaaacggcgggcgggtacgacggagcctatgtggtgtcctcggacgagtttaccccggattacctgagaaagccccaggcggagcgggaacgggaagccagaatcagcccccagggagctgcggcgcggctggccggggaccggtagggagcgggaaaggaatggcgaaaatggaacggaccggtgcagtgcgccccatgcgggcggaagatttggagagcgtggcgcggctggagcagacgtgcttttcggagagctggtcggaaaacctgctgagatccggcctggacaaccggctggattcctatctggtctacgaggagctggggaccgtgcttggctactgcgttctgcgcaccctggcggatgaaggcgaaatccagcgcatcgcggtggatccggccttccgcaggcaggggatcgccaggaaactaatggagtccatggcagcggttgccagaatgaagggggcccgggaggtggctttggaggtgcgcgagagcaacgtaagcgcccgaaagctctatgaatcctatggtttccggcaggaggcggtccgccgggactattaccgcaaccccgcggaggatgccatcatcatgtggaaccgcaggatttgaaacaatttccacttaaattcgacaggttttgcgtatataatggagaggaatcagacattcctctctatttttagtgatacaggcctccccgcttaaccggcgggaaagcggccggcccttacggatctgcggaaaggggagagcggatggatggaggattgagaaaggtgagggtaatccatgagaaagtacaataggaacgggcagctggacacagtaatctgcaactgctgcggaaagaaattgattgtggatcagggtatcttgcgcgagggctgcatctgcgttgaccacgcctgggattttttctccgagaaggacggggaaatccaccattttgacttgtgcgagagctgctacgacgagctgactaaccagtttaaaatcgcggtggatgtggacgaacaggtagaatttctgtaggaaatattaagaaggattaaggttgtttaaggcttttcttaacggtattgagccgtgcccggttctatggtaatgttgaattacacatagaccgggcgttttcatttgcatgcaatgggccgtcggcgcagccgccaggcggttgtccgatccggcggtccggcggcattttacatccgcgctaggcggatggacgccccagcgaaaaagggaggaattgtattatgaagagaggaaaacaactgacaatcgggctgctgatgtgcgcgctgcttgccgggcttttgagcggctgcggagccggaggcggcaagacggcttcggccacagaggcggaggtgaaggcggaggccggttcctacgccagcgagaccatggcggcgcagagccagtgggacggagcggtcatggaggcagaggggccccctttaagccataacacggaggaatacaattacatcgctgaaaacgcatttctggcggtggcaaacgctccgctgtccacctttgcggcggacgtggacacggcctcctacgccaatctccggcgaaaaatcctggagggaaacgaggtgcccgcggacgcggtgcgcatcgaggagatgctcaactattttacatacgattatccggagccaacagaggacgagcccttttccgtgaccacctatatcggggactgcccctggaatgaaaatcataagcttttgcagatcgggctgcaggcagagaagccggatctggagaaccagaagccgtccaatctggtgtttctgatcgacgtgtccggttccatggagtccgcggataagctggggctggtgaaacgggcgtttctgctgctgacggagaatctgcggccggaggacacggtgtccatcgtcacatatgcatccagcgatacggtggtattggacggcgtttcaggcgaagagaaagccgcaatcatgaccgccatcgagaatttgaccgcaggaggcagtacggacggctccaagggcattgagacggcttaccggctgtctgaggagcattttcagaaggacggcaacaaccgggtgattctggccacggacggcgacttaaacctgggtctcaccagcgagggggatttgactcgcctgatccagaagaaaaaggagagcggcgtgttcctgtccgtcatgggctttggcacgggaaatatcaaggacaacaagatggaggcgctggcggataacggcaacggccagtacgcctacgtggacagcctgatggaggcgaaacgggtgctggtggaggagctgggcggcacgctgtttaccgtggcaaaggacgtcaagctccaggtggagttcaatccggctaaggtcaagggataccggctgatcggctacgagaaccgcctgatggaggccagggattttgacgacgacgccaaggacggcggagagattggagcgggccaccgggtgaccgcgctctatgagctggtgccggccggatcggacgaggatttgggagaagtggaactcaaatacggggcgggaaatgccgcggcgaccgaaaacggtgagaatggcggggcagaggcgaggccggcagaaggggcccccgccccgggcgcggattccgagtggctgacgctcaaggtgcgctacaaagagccggacggggagcagagccgcctgctggagtatccggtggacgacagcgcggtctgccgggagctgccgcctgacatgcggttcgcttcctgcgtggctcagaccggaatgctgctgcgggactccgagtacgcgggcggctccagctacaaggccatcgcagccgagctggagcggatagacggccttcgcggcgacccgtacaaggaagaatttctctatctggtgaagcggctggcagcgatgtgaggggctgcctgcgggaaagttttgccgggagagcaacatttcccggcgcccacttgattatttccgctcagttgtgttatgattcagcaaggaatatatgtaacggttcagatggctcatcttcttgaccggaagagatcggtcaagaagcatcggatatccatccgatgtaaaaattggcacgaaaatccgcttacaagcaagcttgacgcggcttcccgcgccaatttccccaccgtctgaactgttacgaatatatagagaatgaggacaaacctatgctggatatatgtttattgggaacaggcgggatgatgccgctgccctaccgctggctcacatccatgatggcccggtgcggcggcagcaacctgctaatcgactgcggcgaaggtacgcagattgcacttaaggagaagggctggagccccaaacccatcgacgtgatctgctttacccattaccacgcggaccacatcagcggccttccggggctgctgttgaccatgggaaacgctgagcggaccgagccgttgacgctagtaggccccaaggggctggagcgggtggtgggggctctgcgcaccatcgccccggagctgccctttgagctgcgctttatcgagctggcggagaaccgggagcggctgcagctggggccctatgtgatcgacgcctaccgggtgaaccataatgtgatctgttacggttacgctgtctccatcctccgcaccggccgtttcgacgtggataaggcccgggagcaggagattccgcagagattctggagccgtctgcagaaaggcgaggagattgagcacgagggacggctgctgacgccggatctggtgctgggaccggaccggaaagggctcaaggtggtctactgtacggatacccggccggtgcccgtgatcgcggagtacgcggaaggtgcggacctgttcatctgcgaaggcatgtacggcgagaaggagaaggccgccaaggcccgggagtacaagcatatgaccttctacgaggcggcggagctggccaaaaaggcccagccggcggaaatgtggctgacccattacagcccctccctgaccaggcccgaggagtatatgaacgaggtgcgccagattttcccgcgggcaaaggccgcaaaggacggctggacggtggaactgggatttgcggaagattagccgtttgaacggttacaagattagaataccggcctgcgggcagatggagatagaaaaatgaacgaagatgttttaatactggcgattgagagctcctgcgacgagacggccgccgccgtggtgaaaaacgggcggaccgtgctgtccaacgtgatttcctcacagatcagcacccacacgatttacggcggggtggttccggagatcgcgtccagagagcacatcaaggcaattaattacgtgataaggcgcgcgctggcggaggccggcgtggggctgccggagatcacggcggtgggcgtcacctacgggcctgggttagtgggcgctcttttggtgggcgtggcggaggccaaggccctggcttacgcggcgaaaaagccgctgatcggcgtgcatcatattgaaggccacgtttcggccaatttcatcgaacatccggacctggagcctccttttgtgtgtctgatcgtgtccggcggccacactcatctggtgattgtgaaggattacggcaagttcgagattctgggccgcaccagggacgacgccgcaggggaggcatttgacaaggtggcccgtgcggtggggctgggataccccggcggccccaaggtggacaggacggcccgggaggggaacccccacgccatcgagtttccccggggcaaggtggacggctcgccctacgacttcagcttcagcggcttaaagtccgcggtgctcaaccacatcaaccacgcgaaaatgaccggcgaggagatccatgtgccggatttggtagcatccttccagaattcggtggtggactccctggtgagccgcaccgtgacggcggcgaaggagtacggttacgggcaggtggctatcgccggcggggtggcgtccaacacggcgctgcgcgcggccatggagcaagcctgcggcaaggcggggattaggtgctgctatccctcccctgttctgtgcacagacaacgcagccatgatcggagcggccgcctactatgaatactgcaatggaaatattgcaggctgggatctgaatgcagtgccgaacttaaagctgggggagcggtagcgatgggagcggaggctaagaatgcggtctgcaccgcggtggtgctggcggcgggcagaggaacccgtatggggataagccaggccaagcagtacctggagatcggagggaagccggtgctggcctatgcgctggaggcgttccagcagtcccccgcaatcgacggcatcgtgctggtgacggaccgggatcacatggaatactgcagaacgcagattgtggagccttacggaatccacaaggtttcggtgtatgcggagggcgggcgggagcgctacgagagcgtctggaacgccctgaaggccatcgcccctacccctgacagacagtacgtgtttatccacgacggcgcgcgcccctttgtcaccccggaaataatcgggcgggcgtataaagcggtgcaaaagtggaaagcatgtgtggtagggatgccggtgaaggacacgatcaaggtgacggacgcggacggggacatagtgtccagcccggaccgccgtctggtgtggatggcccagacgccccaggtttttgagctggagctgatccgggaagcgctgagacgccagctgatggaggattgcagccggattaccgacgacgctatggtggtggagcggcagatgggcgtgcgggttcacatggtggagggcagctacgaaaacatcaaaatcaccacgccggaggacctggatatcgcggaagtttttgcgaaacagcagagaacgggccggttctgagccacggtttttcccgttaaataagggaaaaacaaggtttttgaaaaaaattaaaaaaagttttataaagtgcttgacaaataatgaaatattttgtattatagacgagctggttcacgagagcaaacaacgaacagcacatggagagatatcgaagtggtcataacgaggcggtcttgaaaaccgtttgtccgcaagggcgcgtgggttcgaatcccactctctccgctggcaaggtttcatcgcctgagttaataacatagagcaacaaagatttagccaagcagaagtacccaagtggctgaaggggctcccctggaaagggagtaggtcgttagtagcggcgcgagggttcaaatccctccttctgcgttcggcataagcgcccggcgcgaatgtcagacagaaccttgaaaatcaaagattgaacagtatgtaaaaccctgaaaattctaaaaaataaaggtctggtttagacctttggatttgagaaaattcagaacaaaaccaagtaatgaaggttaaagataactagccaagctaagtagtctaagaccaagaatcaacttttaatttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgtgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaagaagaagtaagggttttatatactgttgaatcttggatttgccaaggtaaagaaatttccggtggcgatgcgcttgggggaaacacccgttcccatcccgaacacgatggttaagactcaagcggccgatggtactatgctggtgacggcatgggagagcaggtggctgccggatttataaagaattttacagtgaggactgttctcgctgaaaaagataaacgttagtatgtgacagcttagcttttgcataattaaccggggcttatagctcagccggttagagcgcacgcctgataagcgtgaggtcggtggttcgagtccacttaagcccagtaggttttagcgagccaatagctttcggaagagaggaaaggcccacttaagcccagttgcttgagaaaaattaagcaaaacaaaatagagatcgccttaagttaagggtagactcgcattccatttctaaaaagatatgggggtgtagctcagttgggagagcacctgccttgcaagcagggggtcatgagttcgaatctcaccatctccattcggaatcgtttaccgatgattccaaaaacgtaccttgaaaaccgcatattgaatgaaaatgaattgaatattctatagaataatcaagacatccgagggatacatcgaaagatgtatcaaatgtaacaaacctaagaccaaacgatccaacgctatggattgtcgatgagtcggagcaacccgcaccgacgagtcattttggttaagctataaagagcgcagggtggatgccttggcactaagagccgatgaaagacgtgataagctgcgaaaagcttcggggaggagcaaatatcctttgatccggagatatctgaatggggaaacctggctgagtaaccctcagtcgacgtatggtgaatacatagccatacgctgggaacccggtgaactgaaacatctaagtagccggaggaagagaaagaaaaatcgattcccaaagtagcggcgagcgaaatgggaagagcccaaaccagcgtgcgtgcacgctggggttatggactgcataagcgagttgattcgttagtggaactgtctgggaagtcagaccaaagagagtgaaagtctcgtacacgaaagcgatagacagcggcaggatccagagtaccacgagacacgtgaaaccttgtgggaagtcggagggaccaccctccaaggctaaatactccttagtgaccgatagcgcatagtactgtgaaggaaaggtgaaaaggaccccgggaggggagtgaaaaagaacctgaaaccctgtgtttacaagctgtggaagcacgttaaggtgcgaccgcgtactttttgtagaacggtccggcgagttgccggtactggcaaggttaagtggttaagccacggagccgaagggaaaccaagtctcaaatgggcgtaaagtcagtacaggcagacccgaaaccgggtgacctatccatgtccaggttgaagcggaagtaaaattccgtggaggaccggatccacatccgttgaaaagggtgggaatgaggtgtggataggggagaaattccaatcgaacccggagatagctggttctcctcgaaatagctttagggctagcctcatattagtttagcggaggtagagcactgaattcctaagggggcgtcaaagcttaccaagggatatcaaactccgaatgccgtataaatgatgtatgggagtcagactgcacgagataagttgggtagtcaaaagggaaagagcccagacctacagctaaggtcccaaagtgtgtgttaagtggaaaaggatgtgggatttcagagacaactaggatgttggcttagaagcagccacacattcaaagagtgcgtaatagctcactagtcgagaggtcctgcgccgaaaatgtccggggctaaaacacaacaccgaagcttaggaatcacttttagtgattggtagaggagcattcttaaaggaacgaagcagtaccgacaaggagctgtggacttttaagaagagagaatgccggaatgagtagcgagatggaggtgagaatcctccaggccgaatatccaaggtttccagagtaaagctgatctgctctgggtaagtcggggcctaaggcgaggctgaaaagcgtagtcgatggacaacaggttgaaattcctgtaccgcgtattatcagaactgtggggacgcagaaggacaacacaacccgggaatgggaagaccggggcaagcgaggtaggagtatggttggcaaatccgccgtacaatccgaagacgtgacgcgtagcgaactataagtagcgaagtgtgtgattccagctgccaagaaaagccgctattgtgtaatacgtgcccgtaccgtaaaccgacacaggtagatgaggagagaatcctaaggccggcgggagaagcattgttaaggaactcggcaaaatgaccctgtaacttcgggataaagggtgccagagagatctggccgcagagaataggctcaagcaactgtttagcaaaaacacaggtctatgcaaaaccgaaaggtgaggtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagcttgatactgggattcggtattgcatgtacaggataggtgggaggctaagaagcatggacgccagtctatgtggagccaatgttgggataccacccttgcgatattgggtttctaacctgcagccgtgacccggctgggggacaatgtcaggtggggagtttgactggggcggtcgcctccgaaagggtatcggaggcgctcaaaggttccctcagaatggttggaaaccattcgcagagtgcaaaggcataagggagcttgactgcgagaccgacgggtcgagcaggtacgaaagtaggacttagtgatccggtggtagaaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcgtaggatatttgagaggagctgtccttagtacgagaggaccgggatggacggaccgctggtgtatctgttgggtaccaagcccatggcagagtagccaagtctggacgggataaacgctgaaggcatctaagcgtgaagcccccctcaagatgagatatcccatagcaaaagctagtaagaccccttgaagacgacgaggtagataggttagaggtggaagtgcagtaatgtatggagctgactaatactaatcggtcgagggcttaaccaaaacggtataggttttaaacatcattcaatatgtggttttgagggtacgttattattaattgaaaaagtgcttgaagaattggcagttttgctgtataataattcggacggcaacaattattcctcgatagctcagtcggtagagcacgcggctgttaaccgcgctgtcgtaggttcgagtcctactcggggagttttttagtggaagtccatggcgaccactacgtttaggccccatggtcaagcggttaagacatcgccctttcacggcggtaacacgagttcgaatctcgttggggtcatttgagtggaagtgatcatgtcactgaggctcgcaacatgccgatgtggctcaacggcagagcagctgatttgtaatcagcaggttatcggttcgaatccgatcatcggctcttactgcgttccagtaagcgcaatatcatatttgatatagttcggacctttagctcagttggttagagcaaccggctcataaccggtcggtcctgggttcaagtccccgaaggtccactcaacaattccgactaatgtcagaactatataacaacttatggcccggtggctcagctggttagagcgccgccctgtcacggcggaggtcgacggttcgaacccgttccgggtcgtttgcatgtttgcatgcggcaattacatgtacgtttggggtcttagctcagctgggagagcatctgccttacaagcagagggtcacaggttcgagccctgtaggccccatttgtatttgcgcgggtatggtggaataggcagacacaagggacttaaaatccctcggtagcgataccgtgccggttcaagtccggctacccgcattttgctgtttgacagcctgagagtgtgattacaacattctcaggctgtttgcgttaagctgcaatagagcgccggtgcggttaccgggctggatgatccaatcagatagggaggcgggtattatgggtgagttgaaaatgagaacggaactgttgaatgtggggaatcgtttgcccaaggaagcgcgggggatggaggaacagcccctttaccggtccaccgtgttcgagacagaggataccggcgactatgaccgggccaactgtggggagcggtacctatacgaccgcatcgaggcgcccaaccgggattgcctgggggaggcgatttccaggttggagcgggggcaggacacggcggtgttcggcgccgggatgggagccatctcagcggtatttctggctttgaaccggacaggcagccatgtggtggtgaaccgggcggtttatggagagaccatcgagtttctcaacgatattttgactgcatacggggtggatgtgagttatgtggattttgagtccccggaggcggtggagcaggcggttacagagaggaccacgttgatttacacggaggtgctcaccaatccgctgctgcgggtggtggatttggaggcggtgacggcgctggccaggaggcgcggggttctgacggtggtggacagtacctttaccacgccgatgctgatccggcccctggagcatggggcggacctggtgattcacagcctgaccaagtattttggcgggcacagcgacattacgggcggctcggttaccggcagccgggagctgatcaaaaaggtaaagcggacgcaggtgcttttgggaagctgcatggcgccggattcggcctggctggcgctgcgtagcctgcggaccatggatttgcgtgtgaggcggcagatggagaatgccgcggccattgccggggcattggaaggcgatccccgggtgcgctatgtgaattatccggggctggtatcccacccgcagcatgagctggcgggcaggctgctggacggcggttatggggcgatgctgagcttccgggtggaggacgatctggagaaggtggatgagatgattcaccggctgaaggtgatccggtatctgggaaccctgggcggcatccgcaccagcctggctcaccccgccaccgcgtttcgacatgaattcagccgtgaggagctggaaacggtgggaatttacgacggactggttcggatttcggcggggatcgaggatgcaggggacttgattgaggatttgagagaggcattgagggtgtttggggagtgaggcgacggaaaagtggggaggtgtgtatggtggagagacctgaaggtgcgaatgtgaagtgaacatgaaaatgtggggggattcgcactagggatttggaaagatatgggaatatagcttgatggggggaaggaaaagattgcgttttggtgggggagggtgtagaatatagatgaaatcgttggggagttatggggagattattggttagttttgctgtcacgccttatgggggcgtgtggatcgaaatggaagtttgactgtccgtggactagcttaggttggtcacgcctcataggagcgtgcagatttagcttccaactccaggccgccttctacctaaccacctccacccaactattccgtccttacctaacaaactattcccccttccaaaaaccaaagcccgccagactccaaattacctccggagcccagcgggctttcttcctatttatatatattcttttaattccaattatttctaatttgtccccttcttcaaattcttctgcgccgtggccagcatgagcttgatgcggttcagctggttgacttcgctggcgccgggatcgtagtctacggcgatgatgttggactgcgggtagtggcggcgcagttccttgatcacgcctttgcctacgatgtggttgggcaggcagccgaagggctgggtgcagatgatgttctccacgccgctgtggatcagctccagcatctcgccggtgaggaaccagccctcgccggtctggttgccgagggagacgaagccctgggccatgcgggccagctcgtcgatggcggccgggggcgtgaagtgcttgctggcctccagctccttgcgggcggtccggcggaagtattccaacagggcgattcccgcgttgcacaggtaggtcgtggtctttttggcgcccagatgcttggatttgaagttgctgttgtagaagcagtacagcaggaaatccatcaggtccggcatcacagcctcggctccctcactctctaaaagctccacaatgtgattgtttgccagaggcgagaatttcaccaggatctctcctacaatgcccacacggggctttctgacgtctctgaggggcaatgcgtcgaagtcccggatgattccccggatattccggccgaattccatcatggacgagctgcgcttggacagagaggccacgcagcgcttcttccatttctcgtgcagcgcgttggcgctgccgggctccgcctcgtaggggcgggtggcgtagagcacccgcatgaagatgtcgccgtagactacgccctgcatggccttggtgagaaggggcagggtgatggtaaagcccgggttggtctccatgccgttggcgttgaccgagatcacggggatctggggcatgcccgccttctcaagggcgcggcggatgaagccgatgtagttggacgcacggcagccgccgccggtctggctcatgaacacggctgtatggtttaagtcgtaacggccggagagcagggcgtccatgatctgtccgatgacgatcagggaggggtagcaggcgtcgttgttcacgtactgaagccccacgtccaccgcagagcggttgtggttctgcagtacctcgattttgtagccgaaggagcggatggccggctcgatcaggtcgaaatggatgggcgacatctggggacagagaagggtgtagtcctttttcatttccttggtgaataccgcccggtggtaagcgctggagacaaccttgcgctcaaaatgccgttggtcccgcacgcggagagccgcgatcagggagcggatgcggatgcgggccgcgcccaggttgttgacctcgtcgatcttcagcacggtgtagattttgccggagcgggtgagaatgtcggacacctggtccgtggtcacggcgtccaggccgcagccaaagctgtttaactgaatcaggtccagattctcctgggtcttgacaaagctggccgccgcgtacagccgggagtggtacatccactggtcggtgaccaccaggggccgctccaccttgcccaggtgagagaccgagtcctcggtcaacacggcaaagccgtaggaggtgattaactcggggattccgtggtggatctccgggtccacgtggtaggggcggcccgccagcacgatgccgcgtctgccggtctgcttcagccagtccagaacctcctcgccctttgcctccatgtcccggcgggactgcaaaagctcctcccagccggcatgcgcggccatgcgcacctcagccgccgggatatcgaatgccttaacgaattccgccaccagcgccttggtcagaatctcttcgttggtaaaagccatgaagggattcataaagttcacgtgctcctcagccagttcttccacgttatttttgatgttttccgcataggaagtgaccatggggcagttgtagtggttgcccgcatccggagtctcgttgcgctcgtaggggatgcaggggtagaaaatgaatttcaccccctgcttgatcagccagctgatgtgcccgtggaccagcttggccgggtagcactcggactcgctggggatggactcgatgcccagctcatagagctggcgggtggactggggcgacagggtcacgtggtatccaaggcgctcgaaaaacaccgcccagaacgggaagttttcgtacatgttcagcactctggggattcccaccacaccgcggtgcgccttgtccaggggcaggggcgtgtagtcgaacatccggtggtacttgtagtcgaacaggttggggatttcctttttggacttttcgattcccaagccccgctcacagcggttgccggagataaaacggcggccgctgccgaactggttgatggtcagcacacagtggttgttgcagcctttgcaccgggtcatggaggtggtgtatttcagaccggtgattttatcaagcggcagcatggaggtctccctggcgctgtccgcgggctgcatgtgccagcgctccctagcgatcagcgccgcgccgaaggcgcccatgatgccggcgatgtcggggcgcacggcctcgcagccggaaattttctcaaagctgcgcagcacggcgtcgttgtaaaaggttccgccctgaaccaccacgtggcggcccagatccgaggggcgcgtaattttaattaccttaaataatgcgtttttgatcacggagtaggccaggcccgcggagatgtccgccacggtggcgccctccttctgggcctgcttgacgttggagttcatgaacacggtgcagcgggtgcccagatccgtgggattctccgcgaacagggcttcttttgcgaagtcctccacgctgtagtttaagctcttggcaaaggtctcgatgaaggaaccgcagccggaggagcaggcttcgtttaactgcacgctgtccacggtgccgtccttgatcttgatgcatttcatgtcctgtccgccgatgtccaggatgcagtccacgtccggctcgaaaaatgccgccgcgtagtagtgggagatggtctccacctcgccctcgtccagcatgagcgcggactttaacagcgcctcgccgtagccggtggagcaggaccaggcgatgtgagcggcggggggcaggatttcccgaatctccgcgatggcccggatggcagtggccagggggcttccgttgttgttgtcgtaaaagcggtagagcagctcgccgttttcacccaccagcgccaccttggtggtggtggaaccggcgtcgatccccagatagcagttgccgctgtagcgggcaaggtccccggttttgacctgatggccggcgtggcggcggtcaaattcatcgtagtccgcctggtcccggaacaggggctccatgcgcttgacctcaaaatccattttgattccggaagaaagccgctctatcatggagagcagggatgaagacgtttgtccttcctggggatttaaggccgcgccgatggcggcgaacagatgggagttatccggagcaatgatctggctgccggtcaggtgcagggtgcggataaaggcgttccgcagctcggggaggaaatgtaaggggccgccgaggaaggcaacattgccccgaatgggtttgccgcaggccaggccgctgatggtctggttgaccaccgcctggaaaatggaggccgataaatcctctcgggtggcgccctcgttgatgagcggctggatgtccgatttggcgaatacgccgcaccgggctgcaatggggtagatggccttgtaatgtctggcataatcgttcaggcccgccgcgtccgtctggagcagggaagccatctggtcgataaaggatcccgtgcctcccgcgcatattccattcatgcgctggtcgatgccgccggagaagtagatgatcttggcgtcctcgccgcccagctcgatggccacatcggtctggggcgcgtagtcctgaagcgcggaggccacggccaccacctcctggacgaagggaacctgcaaatgatgggagagcgccagtccgccggaaccggtgatcacggagacaacctccatgggcccggccttttcccgggcttttcgcagaagttccgctaaagtttcctggatattggcataatggcgttcataatcggaaaataatatattatgctctgcatccagcagagccacttttactgtagtggaaccgatgtcgattcccaatgtgggggatgtatgtaaagaattcataatggtggaattaaccaaacctccttcgtagccggacatctcgaggacgttcttgtgggaaaagaacgtaaaatcgtgatcccggcgcatgcatcctaaagtttaacataaaataggtaggaatacaatcggaaggcagcgttaaaatattgtaaatgaacggtaaaaattgtgcaggtttgcaaaaaaacgtcggatttctgtttgacaaacaatggtgcagtcactataatgagaacgtatatttcataatggggggagagttcgcatgattcgtatttttaagacagaagatggaataatgcatgagaaggatgagcttcagccgggcagctggatcgcgatgaccaacccgacggcctcggagatcatagatattgcggacatgtaccagattgatccggatcacatcaaggcccctctggatgaggaggagcgctcccgaatcgaggtggaggaggactacaccctgatcctggtggacattccgtccatcgaggagcggagcggaaaggactggtttgtgacgatccccatgggcatcatcaccaccaacgaagttctgatcacggtctgcctggaggagacgccggtgctgacgtcctttatggacggacgggtccgggatttccacacattcatgaagaccaggttcattttacagattctgtataaaaacgccacccagtacctgcaatacctgcggatcatcgacaagaagagcgaggtgatcgagcgcaagctgcatcagtcccagaaaaactcggaactgatcgagctgttggagctggaaaagtccctggtgtattttaccacctccctgcggtccaacgaggtggtactggaaaagctgctgcggacggaaaaggtgaagaagtatcccgaggacacggaccttttggaggacgttatcatcgagaacaagcaggccatcgagatggcgaacatttacagcggcatcctcagcggcacaatggacgctttcgcctcggttatctccaacaacctgaatattgtgatgaagtttttggctacggtgaccatcgtgatgtccattcccactatggtggccagcttctatggaatgaacgtgaattcccacggtatgccctttgcggacagcccctacggatttgggatcgtgctggttctggccctgctgctgtccctgatcgtggcgtttattttcaacaaaaaggatcttttctgatcgacagggatccaatatgacaaaaggatgagaacatgaaattttttcagaaaatggaacgaaaattcgggcgttatgcgattcacaatttgatgtactacattatcatgctgtatgtggtgggatttgtgattttaaagttcgccccggagctgtattactattatctgatgctggatgcgccgtcgattctgcacggccaggtttggcggctggtgacttttatgatcttcccgcccaccaccagctttatctggattttactgctgctgctcatgtattattctctgggttcgtccctggagcgggtgtggggtgcgttccgcttcaacgtgtacgtgttcatggggattctgggacatattatcgcggagctcgcagtctattttgtgacgggccacagcccccatctgaccaccacgtttctcaacgcgtccgtttttctggcttacgcggtgacgtttcccaacgagtatttttacctttattttgtgattgcgatccgggcgaaatggctggccatctttgagggggccggatttcttctgctgtttgtcacgtcccacagcctgggaacgcggctggaaattctgctgtctctggccaactttatcattttctttgtaatgacccgggattaccggcgcataagccccagggagatcaagcgcaaacaggagttccgcgcccagatccggcccaagagccgcacgcgccatgtctgcgcggtctgcggacgcacggacgaggacagcccggggatggaattccgttactgctccaaatgcgagggcagctatgaatattgtatggatcatctgtacacccacaaacacatcaagaagtccgatcaggaacagcagtgaccgggcgcgcacaaacttttcagttatggaggattgacaaggaatgaaaaagactaaaattatctgcaccatgggtcctaacaccaatgacaagaatattatgatggaactggcgaaaaacggcatgaacgtggcccgcttcaatttttcacatggggattacaacgagcacatggagcggctggagctgttaaaagaggtgcgcaaggagctggatatcccggtggctgcgctgctggacaccaaggggccggagatccgcaccggacttttaaaggacggtaagaaggttacgctgaaggacggccagaccttcaccctgaccacccgcgaggtggtgggagacgaccacatcggccacatcaattacagcggactgaacgaggacgtggccgcgggcaacaagatcctgatcgacgacggcctgatcgaactggacgtggtggaggtgaagggaacggatatcgtctgcaaggtggccaacggcggcgagctgggcgagaagaagggcgtgaacgtgcccaacgtcaagatcaagcttccggcgctgaccgacaaggacaaagaggatatcgtgttcggcatcaagcagggctttgattttatcgcggcctcctttgtccgcaccgcggactgcattcgcgagatcaaggaaattctggaagcccacggctccagcatgaaggtgatcgccaagatcgagaatgcggagggcatcgagaacctggatgcgatcatcgaggccagcgacggcattatggtggcccggggcgacatgggcgttgaaattccggccgagaaggttccctatatccagaaaatgatcatccgcaagtgcaacgagcagtgcaagtccgtgatcacggccacccagatgctggattccatgatccgcaaccccagacccacccgggcggaggtgacggacgtggccaacgcggtttacgacggcacggacgctgtgatgctttccggcgagacggccatgggtaagtatccggtggaggcgctgaaaatgatggccaccatcgtggaggattccgagtcccatctggactacgaggcgtaccgccgccgcaaggtttccaagaccaacacccagaacatttccaacgcagtctgcttcgcctccgtgtccacagcccacgacctgggcgctcaggcgatcatcgcacccagcatcaccggctttaccaccctgatgctgagcaaatggagacccagcgcccagatcatcggtatgtctcccagtatgtccacggtgcgccagatgcagattcagtggggcgtggttccggtttggtcccgccgcgcggattccacggatgagctgatcgagaactccatggaggagcttaagaacaaaaatatgctggagctgggcgacctggtggtgatcaccgcgggcgttgtaacctatgccagacggcatgaggctgcgacccagaccaatatcatgcgcgtgctgaacgtggaatgatgtatggattcatgaatacgcaagaataactggacaaaggagtccgtcctggagtacaatggtgcaaaagcaccgtggtagtccgggcggacttttttacgtgtccgcccgctgcgcacgtttaaggagagcagcggagcgcggccgcaccggcggcgaggcggccgggcgggagtatggccatagaagggagaatatgcagaatggataaaaagccatttgtgacactggagaaactggaagaaattgtaaaagattacccgaccccctttcacctgtacgacgagaagggaattcgcgaaaacgctatgaagctgaagcaggcatttgcctggaataaggggtttaaagagtattttgcggtgaaggcaacgcccaacccgtttattttgcagctcttaaaggagtgcggctgcggcacggactgctcctccatgacagagctgatgctgtccgaagcctgcggcttttccggggaggagatcatgttttcctccaacgacacgccacctgaggagttcgcctacgcggccaggctgggagcgattatcaacctggatgatttcacccatatccagtttctggaggacactctggggtatatcccggagaccatcagctgccggtttaatcccggcggcgtgttcaagatcagcaacgacattatggacaacccaggtgactccaagtacgggatgaccacggagcagatgtttgaggcatttaagattttaaaggccaagggcgcgaagcggttcggaatccacgccttccttgcctccaacacggtgaccaacgagtattatcctctgttagccaggcagctctttgagctggcggtgaagctgaaggaggagaccggggcgcatatcgcctttatcaatctgtccggcggcatcggcatcccctaccgccccgaccaggagccgaacgatatcctggtgatcggggagggcgtgcgaaacgcttaccaggatgttctggtgcctgcgggcatgggcgacgtggcgctgtgcacagagttgggccgctttatgctggggccattcggctgtctggtgaccagggcgatccatgaaaaacacacctacaaggagtacgtgggcgtggacgcctgtgcggtgaacctgatgcggcccgccatgtacggcgcttaccaccacgtaacggtgatgggcaaggagaacctgccctgcgatcacatgtacgacgtggtcggttccctgtgcgagaacaacgacaagttcgccatcgaccggatgctgcccaaggtggataaaggggatcttctggtgatccacgacaccggggctcacgggttcgccatgggctacaattacaacggaaagctgaaatcagcggagcttctgctgaaggaggacggctccgtgcagatgatccgcagggcggagactccgaaggattacttcgtgacctttgatttctgcgatattttaaagaatgattgagtaaaaatgcagctgcgaaaacggatcgcagcggcgggaaaagaggcataggaatggctaagattggttttatcggaatggggaatatggggttcgcgatcctgaagggactgctcaagatttacgagcctgcggatatcgtgttttcgtccgcccacagggaaaagatggagcgggtgaccggacagaccggcgtaccccacgcggcctcaaacacggactgcgcggcccaggtgaagtatcttttgctggcggtgaagccccagtattttgacgcggtgtttgcggatatcaaggaggtgttaaggcccgaccaggtgatcatttccctggcccctggcctgaccatcgaatcctaccggcagcggcttggaagcaatctgcggttcgtgcgggcgatgcccaataccccggccctgctgggcgagggaatgaccggcgtcagctatgacggcgggctgttcacggaggaggagaagcgggagatggaaatccttttcacctcctttggaaagctgcagctggtggaggagcgcctgatggacgcggtgggctgcgtcagcggaagctcgcctgccttcgtgtacatgtttatagaggctttggccgatggagccgtaaaatacggcctgcccagggccgcggcctgccagatggccgctcaggcggttctggggagcgcgaaaatggtgctggagacgggcaaacacccggagcagctgaaggacgaggtctgctccccgggcggcaccacgatccagggcgtttccgcgctggaggaggcgggattccgcagcgcggtgatccgggcctgcgatgcctgttacaaaaagagtacggagattcagtaggacgctccgggaggctgcatgagatgagccggagggccgcggtcggctgcgcgggatcaaccggagcccgcagacggctgcattataaaaagttttgagaaagagggaacgaggatcatgggtgataagatagagcaggagaacctgccggtggtgcgtctggaccggcagctgaaataccaggggaatatcctgaagatttatgaggacacggtggtggccaacggccacgaggcccattgggactatattcaccacgacggggcggcggcggtgctgccggtgacggacgacgggaaaattctgatggtgcggcagtaccgcaatgcgctggaccgcttcacgctggagattccggccggaaagctggacgaaccggacgagccgaaggtcgagtgcgcctaccgggagctggaggaggaaaccggttaccgggtggagaaccaggggaagctggagtatctgatgagcttgaacaccaccgtggcgttctgcgatgaggccatcgacattttcgtggcccatcacctgattccgtccaggcagcatctggatgaggacgaggtgatcaatgtggaggcgtgggagcttaaggatctggaggacctgatctataacggcaccatcaccgacggaaagaccatcgccgcgatcatggcctacgccaggaagtaccgctccacggacaagcgggacgaggccctttcctgacataatcgccggacgggcggcatagactgtggtaaacaagctgagactggcggtggctgtctgtgaaattgcggcgacttagaatggaaatgcgaagtttaaactatcaggattggctgctcgtctgttttattctcggcgttgtcgggggaacagcggcagcccatttttttggcggtcagacggtgaaggcccaggtgctgggagggatgggaccgggctcgtccgtggacggggcggtcagacaggcccttttttggcaggtcctgcgtctgcggttcgcccagctggcggtgggctggcttatgggactgacggtgtacagcgcggtgctgttcggcctggcggcggtctggggcggcgtgaccgtagccgtggtcatgtccgtgctgaccagccagaaggggcttttggggctgcccgcctttctgtgcagcatggcgccccagggggtctgctacgccctggcctgggccgttctggccatgtgggcggggaagcaggagaagaaaatacgcctggcgcccttcgggctgctgcttttagtgggggctttgggcacatttttggaagtttacgccagcccggcgctgtacggcctctggttctgagaggggagcgcgggccggtgcctggtacaaaggaggaaatggcaaatgtgggtgctgtttgcgtttggctcggcgctgtttgcggggattacggcggttctgtcgaaaatcggcatgcaggacatggattcggatgtggggaccgcggtgcgcaccggagtggtgcttgtcttttcctggatgatggtgtttttgaccggttccattgggacggtgggggagataagcggcaggacgtttttgtttctggtgttgtccgggctggccaccggcgcttcctggctgttctatttccgggcgctgcagctgggaaatgtgaataaggtggctcccatcgacaagtccagcacggttctgaccatgctgctggcgtttctgattctgggggaggcgctttctccgttaaaggtcgtatgcatgattttaatcggcgcgggtacgctgcttatgatccgcaggcaggaggggggagcggacggcgcagagcggggctggatggtctgcgctctgctgtccgcggtgttcgccagcttgacggcgattctggggaaaattggaattcagggtgtggagtccaatttggggaccgcgatccgcacctgcgtggtgctggtgatggcctggcttctggtgttcgtcaagggcaagcagggggaggtccggcgtatcaacggaaaaaacggcctgtttctggtattgtccgggctggccaccgggggatcctggctttgctattaccgggcgcttcaggatggacaggccagcgtggtggtgcccattgacaagctgagtattctggtcaccattctgttttcacggctgtttttgggggaacggctgggcaggagggcgttttggggactggcgctgctggtggccggaacgctgcttttgttacgttagagaggaaatgcgatgagactgaagagggctccggtttatctgcggcgtttgatccgggcgctatacataccggcggcggtcaactgcccgcttctcatctggctggcctttcagctgttaaggccggacagcgggatatttttccggacaatggttacggcggttgtgctgctcggtgtctgggcggcgtggatttatctgaatattgttccgtggcccagggaggaattcgccagccgccgcctgaccattatggagggcgggcggcatctgtgccggctggccctttacggcatggcggtacaggccctggggatgtggtttggttatcccggactgaaggcgcttttggaacgggcgggggagaacgcgccgctcgggaaccatccgggtctgtttttgtggggcaactgtatttacgcggtgatcctgctgttcctcctgatgtggaacggtattctgcgcatgtttttcacttccaggcgtctgcgcctggggatgcgggcgctgatgcttatggcgatgtgggttccgggggtgaacctgctggtgctgtgttatgccatgcgcaaggtgcacgcggaatacgactttgagtgttacaaggagtcggtgcgcctggtgcgcagggaatcggagctgtgccgcacccggtatccgctggtgatggttcacggcgtcggttttcgggacctgcggtattttaactactggggacggattccaagggaattgacgcgctatggggcaacggtgtattacgggaaccaggaggcgtttgccacggtggagcagaacgccggggatattttaaaggtggtgcagagggtggccaaggagaccggctgcggcaaggtgaatatgatcgcccactccaagggcgggctggattcgcgctacgccatcagccgtctgggagctgcgccctgggtggcgtccctgaccaccgtgtgtacgccccaccgtggctgccggtttgtggatcgggcctgccgcctgccggagtggctgtaccggggtgtggcccgggttttcgactggggctttgggcggttcggggacgcccacccggatttctaccgggccacgcggcagttttccacacaggccagcgagcgcttcaaccgggaggtgccggatgcgccgggggtattttaccagagctacgccacggccatgagggattgtctcagcgatccgctgctcacgctgccttatctgctcatcaaacccctggagggggaaaacgacgggctggtcagcgtggagtcggccaaatggggcgaatttcggggcgtggtgcgcaaccgcaggcacaggggaatctcccacggggatattatcgatctgaagcgtgaggactatggggacttcgacgtggtggaattttatgtggggatggtggaggaactgcgcgcgaggggattctgaatatatgggggaaattggaaaaatccagtaaaaatagggattttcagacgccgcggctattggagcggcgttttttttatggaatttttaaaaatattttcgcgggattttacaacatattgcgaggaaaaaatggggggttccaacatgtagtatgttttatgttaatcaggtggaaaatggcctcaaagtgggaaaaatgtgtttgattttatcgaaaaatgtggatataatgatagtcagcactatgtaaatgcgtagtttgtgaatgttaggggttaggggataaaagcgatgacggccgacataaaatactttatcgggtaccttgagaatgaaaaaaaggcatcgaagaatacggtcatttcctaccagagagatctggtgcagctggcggcttacctggaggccaaggggatcacggaggcggaaaaggtgaccaagaccagcttgaattcgtacatactgtatctggagaaggaggggaaagccaccaccacgatttcgcgggagctggcttccattaaggcatttttccactatgaactgcgggagggaagaatccgccgcgatccggcggagtttatcaaggctcccaaggtggagaaaaaggcgccggtgatcctgacggtgaacgaggtcaacgcgctgttgtgccagcccggggacagaacacccaaggagcttcgggacaaggcgatgctggaactgctctacgccaccggaatccgcgtgtcggagctgatcagcctgaaactgacggatgtgaatatgcaggtgggctacattacctgccgggaccgcagcaaggagcggatggtgccctttgggaagaacgcccgccaggccctggtccagtacatgggggaggccaggacggagcttttgaagggcaaaaactcggattggctgtttaccaactgcaacggccaggccatgagccgccagggcttctggaaattgattaaacagtacggcgagaaggccggaatcaagtccgatatcacgccgcataccctgcggcattcctttgccgcacatctgatccgcagcggagcggatatccacgcggtgcaggcgatgctgggacattctgatacggcgactacacagatttatacaaactatacggcgtcttccggttgagggggaggccgtttttttatggttgttgtctggatgaatggggagttttgggggatagaggaggttagaatatgatccgtaaatggataatattggcgggatgagcgcaggggaagagggggagaaccgggaaggaaaatgagcggaagggaacggggacaggtggagacggccggggaacggagcgccgcgcggccagttggaccgggagaggcggcctcggtggaccgggagaggcggcctcgggcacttgacattggcgtgcggctcggatataatgagacttgtgtgaatgcggctatggcggaattggcagacgcgatggatttaggttccattgggagaccgtgcaggttcgagtcctgttagccgcagtgaaaacccttgattgagatcaggggtttttttaatggccgtatgttccgatatcctgtccggggagaggaaccggagggcggagcgccgcatagaatagggtattgtacatccttataaaatccgggggagtttccggaggcggaggtgggggtagggagtttgcgcaatatattaagccggaaatgcttgtgccggtgtccgtgctgtggctcatcggaaatgcgttaaagcgtacgcccaaggtgccggaccggctgattccgtatgttttggggattatgggagtggccgggtgcagcgtctgggggtgcgcgaccaggaatgttttctctgaacggagtgcggtgtttttaccgagttgcaatagttggggtgtatgattgttaaatagagtgtgtatgacgaggaggggattgccggtgaacggttatgaatataataatatgggcaggacgtgcccttgctgcgataactatggcggggggagcgtactggcgcaaggtcctcagggactcagaggagaacgggggccgcaaggaccccaggggccaaggggagagcggggcccccaggggcttcagggccccagaggaaacgcgggatgtcagggctttcccgggctgcgcggcgatatcggcccccagggaccccgtggtctccagggggtgcgcggcgacgtagggccgaagggggatccgggggatatcggtccccagggcgtgcgcggcaatcccggaccggtaggtcctcagggggatcagggacccatgggaccgaaaggtgatcccgggcctgttggtcccgctggccctcagggggagatcggcgataccggtgagcgcggtccggctggggagcagggaccgatgggggaacaggggattcagggggagaccggcccccagggtcctcggggagaaaagggctgcgccggtcctcagggggaacagggagtgacggggacgcagggagtaaccggggcgaccggagcgcaggggataacgggtccgaccggggcgcaggggataaccggcccgactggggcgcagggaataatggggccgactggagaacagggagtagcgggcccgaccggggcgcaagggataaccggcccgaccggagcgcaggggataaccggcccgaccggggcgcaggggataaccggcccaaccggggcgcagggagcgaccgggcccacaggggcccagggaatcgcgggggtaaccggtgctgcgggaggtacggggcagaagggggataccggcccggcgcctgggattacagtggtagagagtacgccgaccagctacaagctgagttttaagaccgcggatcaggaggtggtgagtccgaaccttaaatccaacacggagtcttacaatgcggacctgtcgaagtcggggagcgctttgaacattccgctgggcagcctggttctgacggcccagtttggcagcaccgcttccatccgcctctccatcagggccaaagataccgccacgcccgtgctggcggatatccgccggaccagcatctacgatgcgtccgcaatcgagtcccagacgctcaacaatacgaggatcagcactagccaggtactggacgacgtggtttacagccagtcccaggagacacactggatgcggatccggcagcaggacccggccacaaacctgtggtccatgtgccaggtcatcaccttcgcctccaacggcggggccaggacctccatctgcgtggactggttttatacaggcgtaacgttcagtgcgccctcttcataataaacggttatttgaaaatcctccgcgttcaaacgcgggggattcttttccggcaagcccggccgcagcccgggaaatcccgttgcccgcgcgtttcaaacatgatatgatggacagagcaaacggcatgaatcaggcgggaaggagactttgaaaatggacgacacactgcaatactacaatcaacacgcgaaggcgtatgtggacagcacgagggacgtggagttctcgcagacccaggaacatttcttacaatatttggaaccgggcgcgcagattctggatttcggctgcggctcggggcgggacacgaaatatttccggaacaggggattccaggtggaggcggtggacggctccgctgagttcgtccgcatcgcgtcagagtataccgggatcaacgtccgccggatgttgtttcaggatctggacgaggtggagcgttacgacggaatctgggcctgttcttccattcttcatctgccctgcgcagagctggaggaggtgctcgggaaaatggcccgggcgctgaggcggcgcgggatcgtttacacctccttcaagtacgggacagaggaaggcgggcgcagcggccgttactttacgaatatgacggaggcgaagatggccgggctgctggagcggataccggtctatgacgtggaggagatgtgggtgacatttgacgtgcggccgggcagaggggacgaacgctggctgaatatgattttgagaaaacgatagaattttggcaaggagactatattatccgaaattggataataaagcctcctttatctttgacaaccattaaaatgatatccaaaaagttacccccatccccccgaaaccctcaaaaatttacaaatacctaacattttatttacttatgctgaaaaaatacggcatttttagcatattatttacggataagaactttacgcccataaaaaagcgtgctagaataaaatggcatggcatgtaaaatatgtgtaataggtaagtaaaaaataagctaagagggtaggataaggaagattatggatctgtcattttcgtttttctggcatcaggtgacgtccagcccggcggtgatgatcacggtgtttctcacactgtgcgtcattttcctgaacggctgcacggacgcgcctaacgccatcgccacctgcgtgtccacgcgctcgctgaatgtggacgcggcgattatcatggcggcggtgtgcaactttgccggcgtgttcgtcatgaccatggtcaactccaccgtggcggccaccatcaccaacatggtgaatttcgggggccatagcgaccaggcgctggtagcgctcagcgcggcgctgttttccatcgtggtatggtcggctttggcgtggtatttcgggattcccaccagtgagagccactcgctgatcgccggtttgtccggagcggcaatcgcccttcaggggggacttggcggtatcaacggcgcggagtgggtcaaggttctgtacggtctggttttgtctacggtaatcggttttttcagcggatattttgtttgtaaattggtggcatggctgtgccggaatatggaccggcgcaggacggacggatttttccgccacgcccaggtgggcggcgccgcggccatggcatttatgcacggagcacaggacggccagaaattcatgggtgtgctgctgttggtgatctgcctgtccaacgggcgggagaacgcgtcgggcgtgggtatgccggtgtggcttctcctgctctgctccctggtgatcggaatcggtacctcggcgggcggcaaaaagattatcaagtccgtagggatggatatggtgcggctggagaagtaccagggattttctgcggatatcgcgggcgcgctgtgtattctggtatcgacggtattcggtattccggtgagcacgacccacaccaagacgacggcgattatgggcgtgggcgcggtgaagcgtttgtccgccatcaatttcaaggtggttcaggatatggcgctgacctggctgttgaatttcccgggctgcggattgatcggattttttatggcgaagctgtttatggttctgttttgagttggcggaccgttgagtttaaggagataagagaagatggcgaagaagagcgacaattactattttgagaattttatccagtgcgtggagtgcggctgtcaggcggcgatgatgttggaggaaaatctggcgaattttgatgtgaaccgcttgtcggagaatctggacgagctgcacaagatcgagcacgacgcggacaagaaaaagcatgagatgatgggggtgctggtaaaggcgtttataacgcccattgagcgggaggacatcatactgctcagccaatgcatcgacgaggtcacggaccagatcgaggacgtgctgatccgcatctatatcaacaatgtacataccatccggccggaggcgctgcagttcaccaaggtgatcatccgctgctgcaaggtgctcaaggagatcatggaggagtttgccaatttcaagaaatccaagacactgcacggcctgatcatcgagatcaacgccctggaggaggagggggaccgcctgttcatcgactccatgaggcggctgcacacggaggtgacggatcccttggagatcattgcctggcgcgagatttacaatttcctggaaaaatgctgcgacgcctgcgagcatgtggcggacgcggtggagagcgtaattatgaagaacacctgatggggtgtgctcccggagcacagggatatttcctgagccgggggcgattttttgtttggtgaaacaatgggcgcaccggggcagccgccgtctgccgggcgcatttttagctgagggaggtacttgagatggagcgatgtggaaagggaaaatggatcacggccccgttgggggtctgcctgctggcgacggtctgctgcgcgctgtgggggagcgcgtttccctgcatcaagattggttacaggctgtttcagattcccgcggaggcggtgaacacgcagattctgtttgcggggatccggtttacgctggcggggattttggtgatcgccattgcaagcctggggaggcgcaggccccttgtgccgaaaaagggaagctgggggattatccttaaactggctgcctgccagaccgtgctgcaatacctgttcttttatattgggctggcaaatgcttccggcgtgaagtcttccattatcgagggggccaacgtatttatcagcattctggtggccagtctggtgttccgccaggagcgttttacggggcagaaaatcctgggctgcctggtgggatttgccggggtggtgctggtgaactggacgaaggacggcctgggggccgggatgaaatggaacggggagggatttgtgctgctgtccacggtggcctacgcattttccgcagcgctgatcaaggagtattcccgccgggaggacacggtggtgctcagcggctaccagtttgccgcaggcggcctggtgatggtggtctgggggctcgtgggaggcgggcggatcggcgtgacgcaggcgggaccggcggggatcgggatgctgtgttacctggcgtttatctcggccgccgcgtatacgctgtggagcctgctgttaaagcataatccggtgtccagggtggcggtgtacgggtttatgaatccggtgtttggggtgattttgtcggcctggcttctggcggagaacgatcaggcctttggggttaagacggctgcggcgctggggttggtgtgtctggggatctatgtggtcaacaggccgcgggcggcgagcgcggcggactccgtttcatagacggggagcggttcggacatccgatggaaaattggcatggaacggctgcggaagattaagaaaaacgtaatcgtccatcaggttgcatattgcggtggaatgacttataatgaaaaaagtgtaacagcttgtaactgttcagtgggtctgcgcacttgcagcgctgaccgtacgaaaatctaagcctgcaggcaaaaattccattgattaagtcgattctaaatggatttttgctcgtatctgggtactgaacagatacaacagctttatttttgagaggagaatgccctatgaaaaaacggattatcatgatagcggcggcggccgcattgagcgtgctgatggcgttcccggcctttgcgggtacgtggaaggatgtgaacggaagatggagatatcagcggggcgcggagaagtacgccagccaggaatggcttaatctggacggaaagcggtattatatcggctcggacggatttatggtgaccggctggacccaggtgggcagccagtggttttacatggatgagagcggagtcctccagtacggatggctgaaggacaatgataaatggtattacctggctcccgataccggagcgatggtgaccgacaccgtgatcgacgggcggcagatcggctcggacggcgtttgggtgcccgccgaggcgcagacagagccggtgggtctgtccatcgatcccgcaagcgccaccctggtccagaacatggaaggcatcaagaccaacggctacaccatcatttccagcggcagaaccttcaaccgggagaactggaatgatgcgatccgcctggttaaaaagggcagctatgtgaagtgcgcgccgggcggcaattacaagctgttgtccggaacgttctccccgtccaccaagttcgacagcggtctgctgggaaaacttacggtgtacggcgacgatgatcaggtgttgtatacctccgcggatatccgttacgacgcgcagcccattacatttgcggtggacgtgtccggacagaatcagctgcgggtagagttctccctgacgaaggacgacaactggagcgagccggtgctgctgatcaagggcctgaccctgtatcagtaattgctcaatcaaacgtgacggtcaaagggccaaacggttataaacagacaggataaaaggattgcgcggggcttaaaagccggctgcgcaatccttttttagttgcatgtagtgggcgggcggagctgcctgcgggggttgatgaaaggcggggcgggcagcgcagcctgcttgcatggttgggccgcggaaacggccttacggcggctgaatgggaaaatcagggattggcggctatgacgttttccatgtttttgcggttgatccaggcggtggaaacgtccattgcggcgcggcaggcctgggtctggtccagggcgtttagcatcacaaagtcgtggatgatggccttaaagcgcatggcggtgacggggacgcccgcttccaggagattgcgggcgtacatttcaccctcatcccggagcacgtcggcctcgccgtttaagatcatggcctgggggaggccgcagagctgttcggcggtggcgcgcaggggggaggcggtgatctggccgcgatccttggcgcaggacgtgtattgatcccagaaccagatcatgcccgcccggtacaggtaatagcactccgcgaattccttgtaggagcaggtgttgaaacaggcgtttgtcacgggatagtagagcagctgcttgtgaatactggggccgctgcggtatttggccatcagggtcatggccgccgccatattgccgcccacgctgtcgccggctacggtgagcgtgcttaaatccacgggccagcccaggcgggagaacagttccggcagggagcagagcgcgcggtagcactgctcgatggcggtggggtatttggcttccggggaccgggtgtattcgggaaataccacgatggagttggtgcgggcgcagagctcgcggaccagcttttcatgggtgtggtagctgccgaacacccagccggcgccgtggatatagaagatgacgggcagaggcccggacgcgcgttccgggcgcagcagatagagattgatattaccccagcggccggtataaaacggcatggtgtttacggtggcgggatacatgtaaaccggcgtgttctgcgcggtttccagaacctgccggcctttcgcggggggaagttgaaaaataagaggcggtttggagttggcttcgcagacagcttccgcggctttttcgagggggaccagtcgttccatagagtttgaatccttgtggtggatagcgttattttaatttatgacagagacgggcggatggtgcggcgggaattgtggtttcaaggtgcggcgggcgcagggccgcggtttaaagtcccgactggtggagccccgtgaggatggaaacaacgatcaggagtaccaggtaaagggacagggcacaccagaacagaatgttccggcggcgggcctttttctgtatgcgctcaggctcctcgatctccggaatgtggacaaattccagaacctttccgcggctttggcagaaggcggtgaaggcgtcctgctcctcgcggcaggcgaaggtccatttggggatgaaaacgtactgttttatggcctgattttcaatgcacaggaggaacagggtgtccgctgtctcgtaaaaatgagtgtacgcgtcccacgagcgttggaagttgtcctgttcgcggcgcacggtcagcatttccgggaaaaaggagagatcccacgggccggagccgtttatgggaaaacggttctggcgcatccggcggcggtagacatcctcacggatggaggagacactgaataacaggaacacggagaggaacaggcccaggccgaagatgcccagactggcgatgacgtcgccgcttacgatgaaacgggttgccataatcaatgaaaggacagggcagaagaacagggacagcagcgtgctgccgttgcgccataagggccggtggcagcgggagagccccatgagctcggtgtagacgtgggcgaagtcgtccgggcttaactggaaggtaaagcggaaccggcaggagccggaatccggggattgggtctgaggctgggactgattatagggggagggcgtgcttaagtaggctttaaaggcctggatttcgtccggtccggagaacacgcgcttgggcaggacgagataggagtggcttttacgggaaagctcgcgctttaaaagcagcagtcccggggtctccggaaacgcggtgaaggaggaaccctgatggacgacggagaccttatcctcgtacaggcagccattttccaggcgcagccgcatctcctgggagacgggttggcgggaaaaggtccaaaagtagctgagaaatttcaatacggtcaggaccaggaagaatatggtcaggttttgcagggcctggaagagaaaaaagggcagggatagcagggctgtggtgagtccggcgccgatggccagaattccgcccagagcggggatgattagcaggatacctgctgtgatcaggagatatctcatcttccccagcataaacgagtcccaggtgagacggagcgccagctcggccagctccactttcgtgagacggaattgatagatgcgtccttccagtgacatggttgatcctccttggataaatggcccgggcgccggggaaggcgcggggcggggtggttttattatagtgcatggggggaggggttggcaatagggagtatacagatcacgcgggatatagacggaagaaaattggaaaactttcccggatccccacggcatatcttgaagaatagctgtcattaaggtataatggtgagggttcatcagaggtttatatgagggcaaaatcgtctgatccggtttccggcatggagaacgcgagagaagaatactggaaaatgatttatgtaaacggaggatcgggcaataaaaaaaccttgatttccaataaaatcaaggtttttcacaatcggggcaacaggatttgaacctgcgacctctcggcccccagccgagcgcgctaccaagctacgccataccccgagcgaacttctatattatagcaaatgtttttggttttgaaaagccctattttcaaaaaaaatgtaaaggaatttggaacttttatggtaaaatttcacaaaaaaaagaggattatcagtttcgatctggatatgacgctccttgaccacagaacctgggagattccggccagcgccatggaggcgatccggcggcttcgggaggactcggtgatcgtggtagcttccggccggaacatgaacgagccttacagcgtggcctaccgggatatggtgaaaccagacgccattatccatctgaacggaacgcgggtggaggtggaaggcgggaagattattttcgaacacctgatggataaggagcggttgagacggctgctggcgtttggcgaggaacagaagctggcgctgggaatttccgtggacggcggggattattatacctgcccggaggatgtggtctattatgacaaggtgcgctggggaagctcggagcgtaattttaaggatccctggcttctgatggacatgccggtgaaaacgctgacttacgtgggcggcccggagggggcagagcggctggagcggcagtttgcggagtttaaattccccatgttcgcagggcttatgggggcggacgtggtggagcaggaggcatccaaggccaacgggcttatgcggctgtgcgaatattacgggatcgcgccggaacagacggtggccttcggggacagtatgaacgatatagagattatccgggaggctgccattggagtggccatgggaaacgcccatccggggttaaaggcggcggcggactacgtgacggcggacatcggcgacgatggcgtctggaaggcgtgcgtggcgctgggtttatttgaggaaggagacggaaaataatggcaaaacattacgatgttgtgattataggggctggcccgggcggttatacggcggccatgaaggcggcggagttcggcctgaaagcggtggtgatcgaggctaagaagttcggcggaacctgtgtgaaccgggggtgcattcccacaaaggcgctgctgcacgcctccaatatgttccatatgatgcagaactgtgatgagttcggagtgtccacggatttcatttcctttgatttcgggaaaatgcagaagtataaaaaggcggcggtgaagcgttaccggcagggcatcgagggccagtttgagaagctggacgtggatgtggtttatggcaccgcgctgcttcgtcgggataagaccgtggaggtgaatctctccggtggaggcaaggagtattttcagggggaggcggtgattatcgcaacgggagctgtgccgattatgaatcatatcccgggcgcggacctgccgggggtgtggaacagcgaccggctgctggccgcggagagctggaattttgaccggctggtaatcatgggcggcggcgtgatcgcggtggagttcgcgaccattttcaataacctctgttcccatgtgaccattgtggagaagggacggcatctcatggctcccatggacgacgtggtgggggagcggctggaggaggagctgaagcggaaggggatttccgtgtactgcaattccacggtgacggagatcacccaggagaacggttccctgtgctgcacggtgacgcccaacgaggagggggagagtattaccgtgcgcggcgcacaggtgctgatggccatcgggcgtaagccggatctctccgggcttttgggggaggatatgtccctggagatggagaacggcaggctgaaggtcagcaaggagtttgagaccagcgagccgggggtttacgccatcggggacgtggcagccaagacgctgctggcccatgtggcggcggctcagggtacatatgtggtggagcgcattgcggggaaaccccacagcgttaaattggaggtggtgccgggcggaatgtatgtgccgctgcccatcgtgccaaactgtatttataccaatccggagatcgccacggtgggcatcacggcggagacggctaaggccagcgggctgaaggtgcgctgcgggcatttttccatgcgggataacgggaaatccattattacgggggaggagcacgggtttatccggctggtgtttgaggcgtactccaataccattatcggggcgcagatgatgtgtccgcgggccacggacatgatcggggaaattgccacggccattgcaaatggactcaccgcggagcagatgtcgtttgccatgagggcgcagcccacgtataatgaagggatcggtgcggcgatctgggatgcgatgagcggggatgtggagtagagaggcggtttggaggtagggagagggactcaggcggggcgggggcttgcggcggatggtttggaacgggcaggcgcgccgcgggaacgagattaagtgatgagaggatggaacagttatgaatgtaatacaggagcgtttgggaaggctgcgggaattgatggcggagaaagggatggacgcctatctggtggtgacggcggatttccatgaatcggagtatgtgggcgaatttttcaagtgcaggaagtttctcaccggctttacggggtctgctggaaccgcggtggtcaccatggacgaggcctgcctgtggacggacgggcggtattttgtccaggcggcggcacagcttgcgggaagcgggatcaggctgatgaaaatgcgcgaggagggcgtacccacggtgcaggagtatctggtggagaaaatgcccgcggggggctgcctgggatttgacgggcgcacggtgaacgccgccgaggcactggcgttaaacgaggccctggagtcgaagtatgtgcgctttgacggcagcggggacctggtgggaaccatctggcaggaccggccgcctatgagcgcagagccggtctgggcgctggcggattgttatgccggggagaacgcggcggaaaagatccgaaagctgcgggagaaaatggctcaggccagggctacggtccacattttgacgtccctggacgatatcgcctggctgctcaatatccgcggaaatgacgtgttgtataatccggtggcgttggcctatgtgatggtgtttgaggaccggctgctgctgtttgcgaatgagaaaatactggaagggaaagcttatccgtatctggagcatggtgagggattttccgggaccgtgagggagtatttgcagggcctgggcgtcacggtgaaaccttatgaggcggtgtacgaggagacggggctgctgcggggacagcggatcatgctggaacgcaagatggtgaactacgccatttacagccgaatcgacgggagcaaccaggtgattgagcggatgaatcccaccagccaggccaaggcggtgaagaaccccgtagagatggagaatatgcggaaggcccacattaaggacggcgtggctatgacgcggtttatttactggctgaagcacaatgtgggtaaggtggaaatggacgagatcagcgttgcggaacatctgcgggagctgcgtttggagcaggacgggtgcctggggtgtagctttgaaaccatatccgcttatggagcacatgcggctatgtgccattactcggccactgaggagactaatgtgaagctggagcctaaggggatgtatctggtggattccggcgggcagtattacgagggaaccacggatattaccaggacggtggtaatggggccggtgacggatgaggagcgggagcattttacattggtactgatcagtatgctgcggctgggggcggtgaaattcctccacggctgccgggggatcagtttggattatgtggcgagagagccgttttggagccgggggctggactacaaccatgggacgggacatggcgtggggtatcttttgaatgtgcatgaacggccgaacagtatccgttaccggctggtgacggacgcgcgggaaaatgcggagctggaggaaggcatggtcacgtcggatgagccggggctttatattgaaggcagccacggaatccgcacggaaaacctggtgatgtgcgtgaaggatgagaaaaatgcctatgggcagtttatgcggtttgagtttttgacctttgtgccgattgatgtggatggtattgaccgggagctgatgacggatcgggacgtggaattgctgaatgaatatcatcagcaggtttatgagaagatttcaccgtatttgccggaggaagaggcgcggtggctgtggcaggtgacggcggagatttgagagggatgaaagaatcgatgcagaggtgaatgtgagaatatagggcggggacaggacctgcgcggggcgagacggcggcgtgaatgcggttggggagctttggcgcgggttctgtgtttttgggggagagttggaataataaaagacattgaggggtaattgtgatagaatgacggtaggtgttttgaggaatggggggcgagcgcggcaagggtgtgggagtgattcgtgaggatgaatggatgggcgcaggccgggagaaaatgggacggcttgggtcggtttgaataaaaatatagaagagagatggagtttgagatggctaaggatatgagaaagcgagatatgacaggaatggatgggaagagaaacggggaaggacttcggaggaaggaagctgcgggtggcggagcgaagacggcgaagcgcggcggagatggcgagaggaagcagggcggcagcggaactggcgagcggctgcggggcagcgatagaaccggcgggagagtgaaggaaaatggcgaacgcgggtatgcgggaagaacggagaaaaagggggaaggacggaaggcggaacagcagatggggaaggggctggagaaacgtcgggagaaatacctggaaataaatggggatggaggccgggaaaaacggggcaggatcaatggaacggccggtattgagcggaagaaggattctggggaagcaaagcgcggaggaggattccgggggaataccagcggagtaaaaggcggagcggtcccggcaagggggaaaaggagcctttgcccggtatttaagcagtgcggcggctgccagatgctggatatggaatatgaaaaacagctggagtggaaacggaactatttggaagaacagctgaaagggctttgcccggtgaaggggatcattgggatgaaggacccctatcattaccggaacaaggtgcatgcggtatttgaccgcgaccggagaggtaatattatttctggaatttaccaggaaaacagccatattgtggtgccggtggagcggtgtctgatcgaggaccagaaggcggacgagattatcgggacgatccgggggatgctcaaatcctttaagatccgcacctacgatgaggacacgggcttcggcctgctgcgccatgttttggtgcggcgcgggtttgcaaccggggagatcatggtggtgctggtgacggcttcgccggtatttccgtctaagaataattttgtgaaggcgttaagggaaaagcacccggagattacgacgattgttcagaatgtcaatggacgtgggacgagcatggtgctgggggagaaggagcatgtgttgtatggtaaggggtatatcgaggatatgctctgcggatgcaggttccgcatttcgtctaagtcgttttaccaggtaaatcccgtgcagacggaggtgctgtacggcaaggcgctggaactggcggggcttacgggaaaggagacggtgttggacgcttactgcgggatcgggaccatcggactgatcgccagccggaaggccggcgcggtgattggggtggagctgaatcgggacgcggtgaaggatgcggtgaataatgcgaagattaatgggattaccaatgcgaaattttattgtaatgacgcgggaaagtttctggcggatatggcggagaggggagaaaaggtcgatctggtgatcatggacccgccgagaagcggcagcacggaggagtttatggagtccgtggcccggatgggagtgaaaaaggtggtgtatgtgtcgtgtaacccggagaccttggggagagatttgagggtgatgaagaagttggggtatggagcagtggagggatggggggtggatatgtttgcggggacgagacattgcgaggtttgtgtagaattgaggcgaaaatgataagatagaaaaggtatagccatatactaatattttattaaatcttcatgatattttactatgtaaaactattgaataatgaattaaatgtgatataatatatatgtcaggacaatcgagttctggggattgaaaaaatagctttacttagtgggaaagataatacctgatgtaatagcgtataagcattacgtcaggtttttctctattactttaaagtaatgatggattatggcaaaaatgataatttaaggatagtgtcatcagaaattaaaggcataccaccgaattaatatggaggagcaagatggatatgtattttcattttccaccggatttatttaatatcctagtggatacaattccaagattgaataaaacaaaaaaagatttattgttattttttcaaaatgtaggagtgcctagtacatacttgcagccatattacttactattaaatacaaatagatcacaatttaagaagtttgatgtaacaagagaagttttggctactttgaatgaacagacagaaaaaatgcttggtgttcggagaaaacttttgcagaggattgtggagtttgattcatttgaaacatgttacccaaatgataaagacagggcaaaggcaaatgtgtctgatattcagaaaatagttaaattaaaggatacggtaacaaagtacgagaattatcttagcagggaacaaagcgaaaaaatacaagaaaaacagaaagtagttgataaattgtgccaatcaagaaaacactttgttgatttagaacagagattttcccaacttttttctattcagaaccctcaagaaagaggaaaaaaacttgaacaggtccttaatgatatttttatgtattttaaaattggtataaaggaagatttcgttatttacgatgatgaaacggggaaaaattgtgaacagatagatggtgtggtggaaataaatcattatctaacattggtagaaatgaaatgggaaaaagaacctataggcgtagataaagttggaagatttatgtcacgcttattggtaagaaaaaatgtagacggaattattgtatcatatgcatcctttacggaaacggctatcctcaccgcaaaagaggcattatcaatctctgttcttgcattagtcgatttaaaagatatatatgacgtgctgaatcaaaagaaagatttagtggattttttctcagaacttataaaaaatgtgaaactatataaaaatcccaagcccagaattgatataagtggacttaaaaatatagatttcaattactatgattaagtaagttgttaaagcaatggggcattaaaagtatcactatagtacaatcatgattatcagcaatccgtgttgcagcctataagaacgtgataacggtttgtctgatagaaaaggattaccgccgagggataagtaggttttaaagacatcgttattatacactcaccgcatgtggaaagtattgtcgaattgagccggaaataagaagggaaagaaaatagaaaagaaagttggagacaaagggatgagcatttcaaaagaatgggattggagcaaagagaataactcaatttggctttcacctagtgaagaaagctattatgttgtgcaacgttggaaggagaagggttataaaagaatactggattttggctgtggattggggcggcattctgttttgtttgcaaaagaaggctactgcgtgaatgcctttgacctatctgttgaggcgacagagtatttaaaatattgggcagaagaagagcagctttctatagaagtgaaggttgccgatatgcagaatttgccatacccggacgactcatttgatgctgtttttgcgtatcatgttatatcacatacggataccttaggaatcagacaaatccttggggaaatttctaggatattgaaacccgggggcgagctttacatgacattgtgctcaaaagagacatggtctttcaaagatgcaggatatccgaaacttgataacaacactgtaattaaaacggatgatggaccggaaaaggatattccccatttctatgtaaatcttgatgacattattgaattgcttcctaattttgagattgtaagaatacgccataccgacgactgctattttgcgaaacacaggcaaaacagcaagcacttttttatattagcaaagttaaaggagtagaatttgacccggcaaaaattttgaggtttccaggcaagtcggagttcccccaaggcctaactaaccacatattgcagtgatttttttcacatactcaacgcactgcgtctttctgatatccgaatcaccacctctaggagaatgcgaaataattactatcaaattttttgaggggagaagaaatttggaaaaatcaagtattttaatgtacacaactgaagacggaatcactaaagttgaagttacatttgattatgacacggtgtggctctcgttggatcagattgcagagctatttcaaaagaataagtctacaatatccaggcatatcaaaaatattttttcagaaggtgagttattggcggaagcaactgttgcaaaatttgcaacggttcaaaaagaagggtatagaactgttgaacgacagattgatttttataatcttgacgtgatcatttcggttggataccgtgtgaaatctcttagaggaacgcaattcagaatctgggccacgaatattttaaaagaatatatgaaaaaagggtttgccttagatgatgatcgcttaaagaatctcgggggcggaaattattttgatgaacttttatcacgtatccgtgatattagatcttcagaaaaagtattttggcgaaaagttttggaaatctgtgcaaccagtattgactacgatcctaaggcagaaagttccgtgttgttttttaaacaggttcagaataaaatgcattgggcagcacataagcatactgcggtagaggtgatttaccaaagggcagatgcggataaagataatatggggctgactacatggagcggaaaccatataaagcgctctgacgtaggagtggcgaaacattatcttgatgaaaaagagttggatgcgctcaataaaattgtttcagcgtatttggatattgcggaggtacatgctttaaatcaggagcctatgtatatgaaagactggctggagacgattgatgattatcttaggatgaccagacgtgatatattaacaacaaaggggaaagtaacacatcaacaggccttggagaaggctcatttggagtatgagaagtataaaagaaatcaggaatatatattatctcctgtggaatgtcattttttagagagtataggggaattagataagttggacgggaaaaataattattagaattctgacgaaaggtttccactaagggagaattatatgttttcgccatcattatcatccactcaccacaagatggtttggcaaagatagatacaacttttgatggagatacggtctggttgtcaattgattagatggcagagcagttccagagagatagaagtgtaataggcaagcatgtcaggaatgtttttaaagaaggagaattgtctaaagaagcagtatgggcaaaatttgcctacactgatgctgatgggaaagtttatgatgtagattattataattgagcgtttaggagaatagatccaataaaaaccaaggtaccctatggaaaccgcttaatcacaccgcgctgggactatataacggaggaccatttaaatgagaacagaagcgacaatcgcccaatggaaacaattatacgaagtaaccacaagaatccaggcattggagccgtggaatttcctgtgggatctggatatcatcgggatacgggtgggggatgagcctgagaatacggtgttctacagcatattggggaggggcggaggctgttacggaattacggtttatgagggttacgaggcatttaacagtttcctgatgctgactatgcatgagcagatgaacctgtctgtggaatatgctttgtttaaccagatgaacctgacgtgctactggggaagccgtgaagaattgtcggcaaagcagagggatattatcaaggagctgggctataaatatcgcggcaagaataagtggctgtatttcctgtcctgtgagcccggatattatccgtacaatctggaccaggatgaggttgtacggatgacagagcacatggaaaatctggaaatggcgctcacctattataagaaaatggatattcatatcgattttgagaatggcaagatgttctcttttgttttttcgtcagacaggaaaacgtggcaatatggtgaggaaccgctgccatttatcagctatcgttttgggaatcttgtgattacagatgaagagctgttagaagaactggccagggcgccaaaaggggagtttgcgctggaagctgatgtgagaccgctggcagcgtcggtgccagataaggaatacgacaggcctttaaatcctgtcatgagcattctgacagaagccgatacgggggtgattatttcctgtgatatgaatgagccgcatgatgatgccatggtggaactggcagagacgttgatcggattcattttcaaagcgggagcgcccagagagatcagagtttcaaatgtgattgtagcggcagccttggaacagatttgcgagacttgcaaaatcaagctgcggcgtgtgaagcagttgaaaggaatcaacgagttctggatgacaatggggcggtaccgctagagcctgtttgaaaattcattcccgctgtctgcacgcctcacttcgcagtatatttggcccaaattcacttaacgtagcccgctacgccgcgttcatttaggccaaatctcccacaaagtggaacgcacagccaccggaaagcaattttcaaacagcccctagggtgtggtgggccggtatgctggttgactgttataacgatataaccgcggaatggagattctatggcatataaaccggaatcatgggcggaagctaagaaaaaatgcaggcttggggagaaggaaatacagatggcgaaagaattggggttaaatcccaaaagtctgattaaaaatattccgaatcccagggaacagtggaagcttcctgtgagagagtggattcatgacatgtatgaagacaggcagcgaaaaaagaaagcgaaagagtaatgttgtgtaattgtgaattggggggcctatgaacaaaaaactacttttgacactcgccttatccctcatcccccttctttccgcctgcgcttccgccccgaaggcagaaagcccggcagagacagcggagatcgcaacaatcgcccttaacagttcactggacctgtcccaggaagggcggcagccaatcctgccccaggagtatgacaaaccgtttgtccgcgaaatccttgagaaggattctcttgtggtcggcatgctggaggaggacaggccgccgttcttttaccacacgggggacggctccatggatgggctggatgtggagatttcgctggggatcgcaaatacctttggcgtggagctggagctcgaccgcacggcgcggtcgaatcaggagctttatgaaaatctggcccaaggccggtatgatatggtggtgtccaaattcagcatgacgccggagcgggccatgggggtgtcgttttcgactccgtatgtaacgcttaggcaatcgtttctggtgaacaaaaagctggccgcccaatacggcgtggcggattatccctatgatcatttgaggaagccgggggctgcgattgggacggttgaggggacttcctatgagcgctttgtgaggcagaatttcccggaggcggacgtccgggtctatcaggatatcccttcaatggtcgaggccgtggccggggaagaggtgtttgcggcggtctatgacgatctgacctttgtccaggccatcatgaagaattatgagatttcgttgtataccacgatttatacagtggaagaccttcgggattatatttgcgttgcggtggccgacggctcggaggatcttttggagtgtatcaacgcgtacttgatggtgaactgctattcctatgtgttggacgacttgatccgggatttcccggaatgcttctgataaagggcgggtatgaagatggggaaaattctaagaagtccggttttgctgtttgttttgttcgcgttgggaatcctggtgggaatattgtaccgccgtttatcggggtgctggaagtatttggagatatttttctgacgatgctggagctgtgtatgctcccaatcattgccacaatgctgaccatcagtattcacaatgtcctgaaggcgaaagtcggagggaaattcctgggccgggccgcggtgaccagcgttgtgattgtggcggcggttttcgggattacggcaggggtcagctggctgctgcgggggtctattttccagcaaaaggattttcagctggcggccagcaagctgctgatcgagggcgaggccgggatcaattccatgatccgggaaatcagcagttacatacggccggaacatcctgagacgattaccatcggggaaatgatcctgaacattttcccggacaacattattcgggcgttatctcagagtaatgtgctgcaggtggtctttttttccattgtgcttggcattgccacggtgacgctaccgccgaaaaatgaagagctggtcatggatctctgtgaggcggtgaaccgcatttttatggaaattttcgactttatcatgatttttctggcgcctgccattttctgtattatttccgtgcagatttctgcactggggatggatgtgctgctttcgctggtgaggctgctgcttattaccattggaatctgcctgatcatctgcggtgtgtccatggcggtgatgtgcgcggtgacgggaaccggcgtccgcgcgcatttgaaggccatggggaagcccctgtatatggcgttcgctacaggggacgccatccctacgattccctatctgattgacaacctgcataaccaccacaaaatcaaccgggatgtgaccaacacgattcttcccatcaatatttcgctgttcaattatgatggggtgatactgcttgcgctgagttttgtgggcgcggcctcgatatacggtgttacgctacagcccggtaccattgcgaccgcgtttctaatcacgtttttgctgtccaccagttattccgatattatggcgtcgtcctatttgatcgcgctgctgctggagccgttcgggctgcctgcggaagcgatgattgcgatgctgattccgctgaatccggtgctggacgcggtgttcacggcgacgaaggtttatccggtatgtgtgacggcggcggttatgtcgaaacggcatttttttcatccgctttaaaaatggcaccagcgtccacgctccgttccagccggtgtaccgtctgataaaagcagtcctcacatccctcgtccggaaaaccggaaccgaaccggacaatggtgctgtggtccggcgctttttttcgtctgaccattacatagggtcaaatttaagttgattctatattccctatctattataataattctgtataggtgccaagtgggtcgaagacaaaaatggaatttgcgcacatagagacaggcggtggcatgaaaaacgatattgtactgtatcagagaatctatcagttgttgaaaaatcaaattgagtgcggactgctgccggagggcaaaagcctgccgtcccgggcggaactgtgcagggaattccaggtgtcggagaaaacagtgcgccgggtgttggaggaaatgctggaaaaggggctgatcgagacgcggcagggaaaacgtccggttgtgagaaacgctgcgcagaccggccgcgaatttgagacggagactttgcaggaagacgcgacggtgcctcaggatatttttagcaccggccgtctgttttgttatccggtgattgaacacggaattgcccggtgcgccagagaggactgggaaatgccggcagccatcattgcaaggatggacccttctcacgccacagagttttggcgtctgtctcattacgtttggcgcttttttgttgcacggaacgagaatgatttaatcctgcgcgcggtggatagtctgggatttttctatatagagaggctgccggggcctttggaggtgcgggaggcctattggaacagtcttaagaactttgtccgggcggcgggcaaagacggatattcaaaagaggcgttgcttgagaacctgtccggactgtatgggtttggcgcagaccagcgctggatcgaggcgcattaccggaagcggccggatgcgtcctggtgccccggccgttgcgggctggaacagagtctgcgcagcgcggaggaacggtattcccatgtgtatatggatatgatcggcttgattgccattgggcgctaccagccgggcgaccagctgccgacccacaaagagctgcaaaggaagtatgacgtcagcagtgatacgactgcaaaggcgatccgcgtcctgcgggaatggggcattgtgacggcaatacgggggtgcggaatttatgtgtcgatggatttgacagggcttaagaacgtgaaaatttctcccgatctgattggctgtcatttacggcggttcctggacagtctggaacttctggatttcaccatcgacaaagtcgcggagcatgccgccgaatggattccggcagaggccgcggaggcgttattgcggaaaatggaacggctctggaatgaagaatacctttaccagcttacgcccatggcgcttttgaactttattacggattatattcagtattccccgctgaaagagatttaccgggtggtttccagaaattaccatattggccgctgtattcccaaactggtgactcacggcaagtctttcgaaagctgtgcgattcaacggcaggcggtggaggcggtggaatgcctgattcagggagacggcagacggttttctgaaaaggcggcggcgatgtttgggtatgtgcatggcttggttctccggaagtgcgaacagctggggtatttggaggttgccggccgggtatatgacggaacggcactgtggaagagggcgtttcaggattttggcggcgggaaataagcggctgcggccgttaagtgaaaacgacagattggaaacggatattatgaaaatattttttgagaaatactggagaaaaattcttgtaatcggctttggaattcttgtcatcatcacgcttaccttcaatgccatgctgatccgcgggactgcgtacgaggaaggctctcagcatttggatgagttatccgggcagattgcgtcctccattgaaaagcagtcccgcggccagtggaacatgctggacgtgttttaccggtattttgtagatttatccagtgacgattggacggtattgagcggttatatccaggataaaaaggcagattttgggtttgattctttatgtcttgtggatgaggacgcaatgtactacgaccgggagaagtccgtttccctgctctcgaaccgggaagttacagccaaactgctcacggacaggcagccgattattctcgacaatatgttctcaacggaggaccaactgatctttctgataccaatcgaccggcaggtcatcggcgataagacattctgcgcgttgggcgtggtctataacagcaaaaatctgtttgacatgctgaatattcaggcctacaacggcgaagtaatgatgtacatcactcaccagaacggcgttgcacttttccgctccagccaggagaataccatatccggatataatttgatcaacagtctggaggaggcggagtttaagcgcggctcccttgccgcattccgggatcatattcggagcggccggcaggaactgatgacggtgcgcctgggggaccgggagtattatttaaaccatacaccggtggacgtggatgactggcagctggtcacaatggtgccggtggatgtggtcagcggacgattgatgcggtcgtcaatgattacgtttctgtgcatgcttctgatcggtgccctgattgtgatcgcatttattctgatctactcggattcgaccaggaaggtattgagggcagaggaggcggcgcgcaaggcggcggagaacgccaatcaatcgaaaagcaggttcctttccaatatgtcccatgatatacggacgccgatgaacgccattatcgggatgaccaagatcgcgcaggagcatttggaggaaccggtgaaggtgaaggactgcctgaaaaaaatcgatttgtccggccgtctgctggtggggctgattaatgatattctggatatgtccaagattgaaagcggtaagatggttctgaataacgatacggcgtcgctggtagagctgatgcagaacctggtgagcattacccagccctcagtcttttctaaaaagcaggcatttaatatccggctgcacgatatccggcatgagcgcctgatttttgattcgctccgcctgaatcaggttctgatcaacttaatgggaaatgcagtgaaatttactccggaagggggcagcatcagcctggatgtgacggaagaacccgctgcggacgagcagtttgtccacctcgtgtttaaagtggcggatacgggcatcggcatttcccgggaatttcagaagaacctgttttcctcgtttaccagagagcgggacagcaagatcgataaaattgagggaagcggcctggggctggccataacaaagatgattgtgaccatgatgggaggcaccatcgcggtcgagagcgaactggggcagggaagcgtgtttaccgtggagctggatctcccggttgccggagcgccggaggagatgaagctcccggcgatccgcgtattggtggcggatgacgatccggacacctgccgttcggcggccgcctatctgagggaattgggcgcagaggcggacgtcgcatataggggcagggaggcgatcgaattggcaagggcggcggctgaaaatggatccgggtatcacatgatctttttggactggcggatgccggatttggagggaaccgacaccgcaagagaaattcgggaggtggtaggcgaggaggttccgatcctgattatcagcgcttatgactggtccggcatagaagtggaagcaggggaagcgggcatcaacggatttatccaaaagccgttctttaagtcaacgctctatcataatattcagaaatattatttccataacgacctggaacagccaaaggaggagttggagcaaaatgcgctgacaggcaaacggcttctgctggtggatgacaatgagatcaatctggagatcgcccaggagattttgtcttatacaggtgcggtggtggacgtggtccacgacgggcaggaggcggtgaagcgttttgaaaatgcgccggccggttactatgccatgatttttatggatattcagatgcctgtcatgaacggatacgaggcgacaaaagcgatccgtaagatggagcgggcagacgcgcgtcaggtgctgatttttgcaatgacggcggatgcattcgccgaagacattgagctggcgaagcgcgcagggatgaacgcacattttgccaaaccacttgatatgaccgctgtgttgaaggaaatcagaaaaaatacgcagatagcagaacagaaatggggcgaaaatgaaggattataaaaaaagctttttcatggccttggggatgctggccgcggtgggagtgcttgcggggtgttcggcaaagacggccggcgttgatgaaaatatgctgggaataccgcagaccgatccggaacggctgaccataaccgttacatgcaattccggactggatcacttcgccgccgcggtggaggagcggtttccggagatcaggctggtgcaggactgttatacgggccaatatcgaatcagcgagcacattgcccgcatcgggcacaatgatttcggggatatcatcatggtaaaggcaggtcatattcccaggattgacatgtccgatcagttgatggatctgtctacccagccgtttcccgtaaattttaacgccaatgtgcttcagtcggacgaggacggacatattaccctgattccggggccgttgagctttaattgcaatatttataataaaacactgttcgaggagaaggggtggacggttcctgaggactacgaggggcttctggccttaagccaaaaaattgatcagaccggaatccggggatttcggaactgctattttggttccgcttcgcagagttaccagatttatcagtacagtgttttttccgcgctggacacgctgacgcaggtggaaggacagaactggcataataaacttatggcgggggaagcggtctcgttagatccgatggaaactgcttttcaggatatgcggcgcatgatggaaatcggggcggtgcgggtggaagatatgagcgttccgttcaatgcgaatctggaggcgatggccggccgggaagtcgccatcggcagcggtgaaatcgaccacatccggctgctcaacacaggcggggatgaattttgcttcatgccgcatttcagtatgacggacgggcgggggtggcttttaaatctgggatacttttttggggcgaacaaagagctgaaacagccgggaaatgagaagaaacgaaaggctgtaatggagcttctggagtttatcgcttcggaggaggggcagaagcttttggtggaggacgggcttggaatgatgcccgccacccttggagctgagattccggaagatccggtgttggagcagatcagcacgcagatcgagagcggacgctatatcatgcggcccacatatgatatgtttacgtccgtactggggacagagattggggcattcatacgaggagagacggacagcaaagcgattttggaccgatgcagccttattttagagcagggacctccgccggtacagactctcggcgaggcggaggcggatttcaccatattgcagacgggctgtctgaaagcggatgccctgcgtgccgccgcaggcacggatattgctatcgttggcgtatcggaggtgaatggttatgatcctgcgggaggagtccggacaaagctttacaagggggccgtcactgaagatgatgtcgcccgtataacacaggtccggatggatacgccgctcatgagcatgtctgtttccgtgacaggaaacgagctgttgtcgctgctggagtatggcgcaacatcggaaaaagagcagcaggacggagcggtgagccggtttcatccgtttgccgtttccggcttaaagctcacatatcatttggagaatgacgaggggaaacgtgtttcggacgtgacaagggaggacggcagcaaattgcagccggatgctctgtataccatttcctatatcaggggagccttcccggaggggaaattcgacgggaaagaaaccggtattgcgatgacggatgctttgagagattatgtggaggagaaaaagagtcttactccggatgcaaaacgtattcgactccgtatgtgacgaggcaaaccatgcgattgtgtttgttgaacaatcgcatggtttttacgccttatggcttcaaaatcaccttaatacagttatcctccctaacatcaagtccacataccgggtggcggggcactggcccattttatagaaccggaatatatagcttcacttcattttccgggtcctccatcgccagcaccttccgctcataaacctcaaagtcatcccggtcgtccagccgttggcccgacgagggcagccacgtgccgtaaatgtactggtaggtctggagcagcttctcaaggctgccgcggtgggtgaaaacggcgtattttccggggcgcagcgtggtttgagccagggcttccggcagattccggaaatcggggacggggcttccaaccatcacggaaaaggttacgtccccgtccgccgtgtagacggtctgccgggtctcgcagatgctgtaggcggttttcgagagctcgtagagatcgccgtgaaagcgcagaaactgatcccacaactgaggaatccggttccgggaaatggaggtgatgtcccgcagaccggctattttgatttcctccgtcaactgaaggatttccggggaatgggaaatgcctgcggcgatgtgggggacgtccccgggcagaagctggcgtttggcggttgccaccaggtccagacccgctttgcggtagcccgccggggttgttttaaacagtgccttaaaggcccggctgaaggcctcgggcgattgaaagccgctttccagggcgatgtcgatgatccgccggtcggagtgaacgagctgctgggcggcccggtacagcctgcggcggctgatgtagcggcccaccggctcgcccagcacagcggagaacagccgcgtcatatggtaataggaataccccatttccctggatacgtcgcccaggtcaatattttcatccagatgggtttcgatgtattcgattgcccgctcaagcggggtcagatggctcaatccgccgcctcccttctccattttccgttatttcgtacagcgtaccgtaagacctcgtgtatcgagtgcctgctatccgcacgaggacttacggtgcgctgtacgaacattctatccctttatcttaccaagatcaacaaaaaatatcaggaatgtgccgtctttctatgctatgctgtaagatacagctgacccagagtgtgtttgaaaattcattcccgcaaagtgtgacgcacatctgtcggaaagcaattttcaaacacattccagcggaaaatagaaacgaggtatagacggatggaagatatgatcgttcacgggttgacccagaacaatttaaaacatgttacattcaggattccaaaggagaaaatcacggtgtttacgggggtgtcgggctccgggaaatccagtattgtgttcgacaccatcgcagccgagtcccagcgtcagatgaacgccacctacccggtctttgtgcggtcacggcttccaaaatatcccaaaccggcggtggagcgcatcgacaacctgacggcctccgtggtggtggaccagtcgcccctgggcggaaacgcccgctccacggtgggcaccatcagcggcctgtactccagcttgcggctgctgttttcgcggattgggacgccctatgttggcacggcttcctgcttttccttcaacgatcccaacgggatgtgcaggacctgctcgggcctgggaacgatcccaaggcttgacgtggagtccataattgatggggacaaatcctggaaccagggctgcgttaaggattccatgttccgccccggttcctggtactggaagcagtacgccgcctccggcctgttcgacctggacaagccggtgagggagtacaccccggaagagtataatctgctgctgtacggttccaaagacggcgcgggggagccggagaatcccaaggtgacgggcctgtaccgcaaatatgcgaaaacgctgctgaaccgggatatcagcaataagagcaggcatacgaaagagaagtcccggaacctgatcgccggatcggaatgtacggaatgccatgggaaacgattgaaccaggcggctttgagctgtaaaataaacggttattccatcgcggacatgtgcgagatggagctgacccggctccgcgaggttttattgcagatcgccgatccaacggtggacgtgctggtgcagaccttggtggaggggctggaccggatgatcgggatcggcctgccttaccttcatctgaaccgcgagacgccgtccctgtccggcggggaggcccagcggttgaagctggtccggtacatgggcagcagcctgaccgggctgacctacatttttgacgagcccagcgcagggatgcacccgcgggatgtctaccgcatgaataatctgctgcggcagctgcgggacaaggggaacacggtccttgtggtggaacacgaccgggatgtgatttccattgccgactacgtgatcgacgtggggccgcaggccggacaaaacgggggagagatcgtgttcgcgggcagctttggggatttgctgaattccggcaccctgacgggaaacgctatgctggagtctctgccggttaagggaaatccacgccgccccaccggcagccttcccgtccggggggccagcctgcacaacttaaagtgcgtggacgtggatattccgctgggaatcatgacggtggtgaccggcgtggcgggttccgggaagagcaccctgattacccaagtgtttgccgggcagtatgagcaggacgtggtgatgatcgaccaggggccgattaccgccacaaaccgttccactccggcctcttacctgggatttttcgatgagattcgaaagctgctggcgcgggagagcggcaagccagacggcctgttcagctttaattccacgggagcctgcccggcgtgcggcggaaagggcgtgattgtgacggagctggcgtttatggaccccatcgtgacggagtgcgaggcctgcggcgggcaacgttacaaccaggaggccctggcctgcacttataaggggaggaatatcgtggagcttctggggctgaccgcctcccaggccatggatgtgtttgaggaaccgaagatcaggaggcatttgaaggtgatgcagcaggtgggcttgtcctatctgaccctgggccagcccctcagcacactgtcgggcggcgagcggcagaggatcaagctggcgaaacatttgggaaaaaaaggaagtatcatcgtgatggacgagccaaccacaggcctgcacatgtccgatatcaggaacctgttaaagctgtttgacctgatcgtgtcccggggaaataccctggtggtgatcgagcacaatctggacgtgatgaagcaggccgactggatcatcgacatcgggccggacggtgggaacctgggcggccgggtggtgtttacggggacgccggaggagatggtgaaaaatgcggatacgttgacggcggacagtttgcgtgcggcggtgaaggggtgaacggtgtagaggaaatcgaggccaacgcggcggcggtaatagcggccaacacagcaggaatatcgtgccagccgccggaaactgattgacaatcccctccatttccggtaaaataactccatcaattaataagaaaaggtgatgaacgtccggcgttccagatgtcacagaatcggtggtattggcgcggctggagaagagtggataaaatcaatttaacaggcgggggccgtaagcgccccggaacagactgccctggcagttttgttgtgatcccctgtatttgattttattgactctcagcgtttcttcatgattccgggaagattggccgcagagtaatgtctgcggctttttgttttttctgaatgcactgggccgctgacgctgcctgtgaacctttgcattcgccggacaggaaaggagattatgaatgtataagaatttatgttccatattggaaaaaccgctgctgtacacgaaaactgagattcccttctgggacgacgagcacatttccggggaaatgttaaaggctcatctggatcccgattttgagggggcgagcaggaaacttccgtttattgagaaatccgtgcgctggatcggggagctggcgtccgccggcgactacaggcggctgattgattttggctgcgggccggggctctatggggagcggttcgcccggaccggctatgaggtgacgggcgtggatatgtcctggcgttcgattgcgtatgcggagcgctcggcgcgggagaaggggctggatattcggtatctgcagaaaaattatcttcagatggatttgggcgagacctttgacttcgcaaccatgatctactgtgactatggcgcgctgtcaaccgtggatcgtgcggttttgatgaatactgtatacaatcatctgcggcccggaggccggtttctgctggatgtgttcaccatagtgaagtatgaactgtttgaggaggcgcagacgtgggaagtctgcgaaaacggagggttttggagcgaccagccgtatattgaattcgatgggcgctacaagtatccgggcgtcacgctggaacacgccgcgattgtttcgggtcaggaggtgcgcaattattatatctggaatacttatttttcgcgggaagggctgacccgggaggcagaggcggcgggctttcacgtttgcgggctatttggagatgtggctggggcgccgtacggcggggacggacagacgatggcggtattgttggaaaagtaaaatgcggcggggcgggtacatcacttgcagcggggcgtgaacaccacttgcttccatgacgctttttttcaatacagccgccctcccgccgtgctatactgtctgaatcaaaactattttcacagcagaacaaaatggtccgtaaaccggcgtctgcaacctcaggttgcgcaaatgcaaggccaggttggtggctttgacagggtgtttgcattagcatggaagaaaagggaagcgaggtaagcatatgagctttgcagagcagttaagacagattcgcaaggaaaagggattgtctcaggaggacctggcggagctgctggatgtcagcaggcaggcggtttccaagtgggagcagggcgcgggttatccggaggtggaaacgcttttattactatcgaaccggctgaatatttccctggacagcctgatggctacggaaattgccagggagggcggaggcgggagggcggaggtgaccgggacaatcttgatcacgtcgcctcacgaaaatgtggtcgtcagctgttataaggtgatttcttcccagaaaatgaaaacgggaaaggaagcgccccattttgccctcttcggcgtcagcagcgggtgcgcgtcattctggggcgaacccacgacttttttgggatggtacgaggacgaggaacagattgccaaagaggtcggcgccattcaggcttccattctcaacgggcagccggcctatgaactgaagtacagcgtcaaggtggaacggcactggttcggcatgaaaatccttcgggattgagacggggagagggctgatgccgcccatgccgcctatgcggcccgtgtgcaaaaaacagtatgtagaaaggattttgattatggataaaaaattgggatttgaggattttatcgccgccgtagctgcggagaatcaggaatttgtgagggagcttcacgccaaattgacggaactgggctgtaaaatggaggtcaaggctgcaaaaagcggttttgtcgtttcctacagtctcaaccggaagaccatagccaattatgtattccgcaaaaaggggatgatcgcccgcatttacgccgcccatgtcaatcagtatatagaagctttggaggacctgccggaggaactggtccagaccgtaaaggccgcgccggactgcaaacggatgatcgatcccgattcctgcaaccccaaatgtcccatggggtacgattttttgctgaaaggggagcgctaccggaaatgccgcagcaacgcgtttatgttcccggtctgccgggggaacaatccgtttattgggacgttgatgttgaaggaggcggaggcgtgcaggttttgctagatccataaaagggctgcaaagcggggcgtgaacacaaggcggttaaagtgccgcgggtttccgacggagatggacctaaagcgcgtgcccggctggacgccggaactggattttcagatgatttgattgaattaagggagactgcatgataaaataaaatcgttgaaacggtgagaggcgggggtacttggattttcaagtaccccttaaaacttgaacggcaggggaccgcaggtccggccttccgctttttttccgaaaaaggccatggctgtgaagggttcgacaaaggaggacaacatcaatgtcaaaatggcacatgcagaaaattacctgccccaaatgcggcaggaagagcgattttaagatctggagcagcatcaacacggtcattgacccggatatgaaggaaaaggtgaaaaatctggaggcgttccggttcgtctgcccgcactgcggcgcggacgccaatgtgaattacggctttctgtatcaccagatggaagatcacatcatgatctattacgtgaccgacggggagagctttaaaacggcctgcgagatgttgtccggcgattacgggctggatggcaaggctgcggatttgggaatcagagcgatgaagggatataccaaccgcgttgtgactgagcagagcgaacttctggaaaaaatcgccatttttgatgccggactggacgaccgggtggtggaaattatgaaggttatttttcatgtacagatgcagcaggagcacagcgggacggacgtcgaccgcctttatttctatcaggatgagaacggcaggtttgggattcagtttgtgaaagagggaaaggtggttgccaccgccggatttgaacgaaagctgtatgagcgggttgcagaggatttcggaccgaaaatcaggcaatcaggcctttcggagatatcggtcaattcagattgggcgctggagatattgagcgggggcagagatgcctaaaggggagctgctcagttctcgacggttgtcccgccgggaaatgcatccggggcgtttggaatccccggccacaaggattttgcaggtgatatttacaaaatgaaatcaacatggaggaacaaaatgtaccagttaatcgcatttgacatggatggaacgcttttgggatcggataagcagatttcgccgggaaacaggagcgcgatcgcaaaggcggcccgggcgggaaagacggtgattctcaacacgggccgatgcctgtcggagctggaggagtatcttgggctgattcccgaggttcgctatttaaactgcgccagcggtgcgctggtgtatgaccggaaggagaaacggacgctgtattccagccttctgagcgtggagacggtgaaacggcttctggagctggccgccatggagcaggcgatgccccacattctgctggagcagtgcattgtccagaaaagccattgtcagcagatggagcggtttggaatgggagtctatcaggatcagtttgaccgcgtcacggtgaagtgggaggatatcggccgtatgtacggggaaaacccgtttccggcggccaaggtgaatatttaccacacgagccctcagtcccgggccaggaccgaggagcggatccaggcagccggtcttgaggtggccatggcccgggcggagaccacgtccctggagctgtcggctctgggttgcgacaagggcgtgggcctggaaaagctgtgcgcctgcctgaatctgcccatggatcagaccatcgtggtgggcgacgcggacaacgacctggaggccctgaaaaaagcgggtctggccgtggccatggcaaacgccggggaatcagtcaaggccgcggcggatgtggtggtagcggactgcgaccacgacgggtgcgcggaggcggtggagcggtatctgctacagccgtgagcttgcaagctgaaatatgctgtgctatactaaagaaaatactttaataaagtatcgatggaggagctatggcaaaagcgggcatcaccaatatggaggtcaagaaaaacaaccgcaaccggatttaccgctacatctgcaaatgcagaaccgcatccaacccggacatttcctacgcccttaagatcagcctgccgacggtgacgcagaatacgaaggaactgattgaaatggggctggtagaggagatcggggagcttcagtccaccgggggcaggcgggccaaagcgctgtcggccgcggccggttacaggctggcggtgggaatcgatattacgcagaaccatatcggattattgctggcagacctcgccgggacgattttgaagtatgaccggataaattttccctttcgcaggacacgggattattttgatggggtgagcgggaaattggaggagtttttaaaaacagcagcagccgggccggagcggattctggggatcggcatctcgtttccagggattgtaaatttacggaaacaggaaattaccaattcgcacgctctgggggtcagcgccctttcgtttgccgaggtatcgggctgcttcgcttacccctgctttttcctgaacgacgccaacgcgggggcatatgcggagggggcgcgttttgaggagacggattcatttttctatctgtccctcagcaatacggtggggggagccatctttcatgacggacagctgatgcagggcagggagttccggtgcggtgaggcgggccacatgacagtggttccggacggacgggcctgttattgcggaaagtccggctgcctggacgcctattgctctgccaaattcctggcggagcctggcggcggcaggctggaagattttttcgccggattggagcgcgaagagccggagtttgtgcgtgcgtgggaggaatatatgaagtatttgtccatcgcggtcaacaatctccatatggtgctggactgcgatattgtgctggggggatatgtgggaagctatctggaggtgcatatgggggaaattcggaaaaaagtggcggagcgcaacacattttccggagatgggagctttgtgagaccatgtaattataaggtgggagccgcggcgttgggagcggccctgcaggtgatcgagacgtttatcgaacagatatagatatggacggatacggccgtggaaatatggattgaaaaagattcctctgtggagtcttttttttgtgctgatcagccaaatatcagggcgtaaattttacgagattgacggaattaaaaaatcctggcaggaagcgattgacaactcagggcttgacttgtattataaaatacataataaaactatttaataaagtatctaacaaatggttttacaagtcgaacttgcaggaaagaattaaaaacaggaggcgtgagcggtatggaaggaacgatgagagtggcggttatgaccgggatcggaaaaatggggttcgtaaagcgggagattccaaggcccggggcggatgaggttctggtcaggctggagtatgtggggatctgcgggtcggatctgcactattatgagacgggagccatcggggattatgtggtggagccgccttttgtgctggggcacgagccgggtggcgttgtggtggaggtgggagacggcgtgacccatttgaagattggcgaccgggtggcgctggagccgggtaagacctgcggccactgtgaattttgcagacagggcaagtacaatctctgcccggatgtggttttcttcgccacgccgccggtggacggggcgtttcaggagtacatagcccaccgtgcggacctgtgcttcaaactgccggaaaatgtaagcaccctggaaggcgcgctgattgagccgctggccgtggggtttcacgccgccgttcagggggaggcgcagctggggcagaaggcggtggtgatgggagccggctgcattggactggtgaccatgatggcgttgaaggccaggggagtttcccgggtatacgtggtggatattatggagaagcggcttgaaaaagccctggaattgggggccgacggtgtgatcaacgctgcgaaggaggatgtggtggagcgggcggcgcagctgacggacggcaggggaatggacctggtggtggagaccgcaggcacggaaaccacgaccagacaggctgtccagatcgcgcggaaaggctccaatatcgttttggttgggtatggaaagaccggggagatgacgcttcccatgagtcttgtgctggacaaggaactgaccttccggacggtgttccgctaccgccatatttatcccatggcaatcgaggcggttgcgtccggcaaggtgaacttaaagggaattgtcacccatattttcccgctggatgaggtgcagaaggccatggatcacagcgtaaacaacaaggcggatattgtaaaggcggtcattgagataacgcggaaccagtaaaaggaaggccggggcacggagggcagaccgcataaacggattacagaacggtttttgcaacggtctccacaaaccggtgtacgtccccggttggattcaggctgtaaagcaggccgtaggatatggtgaaatcccagtctacgggaatggataccagggctgggtgcacctccgtccagcactccagggtgagcagtacattgccggtttccgcgcagcggttgaatacagacatgtcataaaagggcggcgtatcctcgaggcggattttagggtgatttttggtgatgtagccgcggatcatgtcgtttgtgccggagtccccctgtttgaccatcatcaaggtctcgccgtacagatcttccatgtggatcagttgtttttgggcgaggcggtgttctcttgagacggcgatcatttttcggtagtggcccagcgggagcagacggcagtggttgagccaggtcctggagtcgcagacaccgatgagaaaatcaaatttctcccccagcttggatagctccgtgataatccccagatggtcgtcctcgaacggaaccagatggagtttgtattcgggaaaataacggtttaccctgtaccacagatccatgaagggtttcgccggattcagcagggaggtgcccacgcggaaggtggtccgctccgcacgtgcggccattttcgcgcttgccacggatttgtcggagtagtcgatgagaaactttgcatcctgatagatcacggtgccggcacctgtcagacgcacgccggtggcgccacggtccaggagtttcaaatccagatgcttttccagggcgttgatctgtttcatgacggctgtgggcgatatgtaaagtcgttcggcggcctttgtgaagctgccgcagtcggccactgcgatcaaggtggccagtaggcgattgtacatgggagtacctcctttccggggtgtgaagggttggtttatattatgatagcggattggagggatggtgtcaaataaaagatggttgtacagcgccggatacaaaaatgtatctggtattttttgactatagtataaactaatagtttatactgtggtgacggaacggagattcaaggataaaggggattatggcataatagcgttataacaggataaaacttgcaaggtgatagggaggagcaaccaatggagaaaagagagatgggggtgtttcccacagggaaccccaatgacgtgtatgcgaagtatttcgtgggacagagctatctgaacatgttgtctacggagcaggtgacggtgggaaatgtgacctttgagccggggtgccgtaacaactggcatatccaccacgcgaaaaagggaggcgggcagttgctgctggtgacggcgggaaaaggctgctaccaggagtggggaaaggagccggtgcccctttatcccggggatgtggttcacatcccgccggaggtgaaacactggcacggcgctacgacggactcctggttccagcatctggccattgaggtaccgggggaagaatgcagcaatgagtggtgcgaggcggtgtcggatgaggagtacgcggcgtgtgaagcagtatgcgcggacaaagcggaagttgcggaagaaacctgtgcgccgcccgtggcggaacactccggaaagaaccgggaaaacacagcttttgcatatcgctgcgaattttcggataccgacccggaatttacgggacggttcaaccattttgcgttccaagaagtggcaaatagcagcgatttggacggacatacccggatgctgacgattctggcggcgctggccggatgccaggggaccgatgaattctgcgccctgctgcctgcggcactggacatgggggtgacgccggtggaggtgaaggaactgctttatcaggcggtggcgtatctggggatcggccgggtactcccctttctgcaggcggtaaatgaagcctttacccggcggggtatagcgcttccgctgagagggcaggcggggacgactctggagaaccgtctggagaagggcagccaggcccaggtggatatcttcggagagggtatgagggatttctggaagtctggaccagaggaaacccgtcatatcaaccgctggctggcggagaactgttttggagactactataccagaaccgggctggattaccgtcagcgggagatgatcaccttctgcttcctggccgcccagggaggctgcgaaccccagctggccagccacatcgcagcgaatatcaggcttgggaatgatcaggtatttttgattaaggtgatttcacagtgggttccgtttatcggatacccgcgatgtttgaatgcactgcggtgtgtgaatgagacggcgggagaataaagctgtcacagcattttaagcataaaaacggatggagattcctggactgcgggaattgttcatccgttttttcggcttatggagaatatgaaacgctgtaggttccgcctcatcgtttatagaaagtccatgttacggttagaaggatgtgacaggcaagaggggagtttcagttggttgaaaacagccgatatatacattttgagcatggatatgtatttgatataggtatttgatattgaaatgcaaaccaattagaataataagcgaggatagaattcaaattgacacatgacaaggcggctgtaatgaaagcaggaggaacgaatcatgagacgaaaatggatgatcgcagcaacggcagttctattggcagctggactgacggcaggatgcagcgggggcggttccagtgcgggaaccacggcggaagcaaaacaggaaggacccggtaacggggaagaagctccctcatcctatgaggcagacctgttggcccagatccgggaggccggcgtgatccgcatcggaaccgagggaacctactctcccaacagctatcacgatgaaagcggagctctggtgggattcgacgtggaggtggccgaaaaagttgccgagaagctgggcgtccgggcggagtttgtggagtccagatgggattccctgtttgcaggtttggattccggacggattgacattgtggtgaacgaggtggaggcttcggaggagagaaaggaaaaatatgatttctcggaaccctacacttacattcacggagcgctgctggtggcggcggacaatgatgagattcaaagtttggaggacctggaaggaaaacgggcggcccagaatctgaccagcagttgggggcagatggctgagagccgcggagcggagctggtgggcgtggagtccatgaaccagtcggtggagctgattctcacaggccgcgcggacgtgacccttaacgcggagacggcgttttacgattttatgaaaagccagccggatcagcccgtgaagatcgccggaatgacggattccaccacatcctccgtgattccggtgcgaaaagggaatgaatccctggtaagcgccatcaacgccgccctggatgagatcagggagtcgggggagctggcggagttgtccgtcaaatatttcggccaggatataacggagcaatagactgaggagatggtggaagcgttatgaatcaaaggctgatcgagttattaatcaattcgttttggcagatccttttgcctgggctgaaaattaccattcccctaacagtcctatcctttgtgctggggctgggactggcgctctttaccgccatggtgcaggtggcggaggtgagggggatcaagcagcttgccaggctgtatgtgtgggtgattcggggaactccccttctggtccagctctatgtgattttttatgggctgccggggttgggcgtgacgcttaatgccttcccttcggcggtgattgtatttgccgtcaacacaggtgcctacgcctcggagacaatccgggcggccatcgaatcggtgccggagggacagatggaggcggggtactgcgtgggcatgtcctacgtgcagaccatggtgcggattatcctgccccaggccctgaggacggcgtttccgcctttgagcaactcgctgatcggccttgtaaaggacacctccctggcggccaatatcacggtgatggaaatgtttatgtcggcccagagaatcgcggccaggacctacgagcctttcgcgctgtactgcgaggtgggggcggtctacctgattttctgcacggcgctgaccagggtgcagcggatatgcgaagcaaaaatgaaacatgaatgacaggaggcgcagcggatgctggagattaaacagatcaaaaaatcctttgaagggcaggaaattttaaagggcgtggacctgaaggtggaaaagggcgacgtggtgaccattctcgggcccagcggctccgggaaaaccactcttctgcggtgcatcaactttcttgagagggcggatgagggcgctatgatttttgaccgggagcgtctggacttaagcagcgtgcaaaagcgggatatggcgaggattcgcaggaagaccgcctttgtgtttcagaattacaacctgttccggaataaaacggctttgcagaacgtcacagaggggttgattgtggcgcgcaggctgccgaaggacgaggccgtcggaattggtaaacgggcgcttgacaaggtggggctttcggaccggtacgattattatccggaccagctctcaggcggacaacagcagcgggtgggcatcgcccgcgccattgccacggacccggaagtgatccttttcgacgagcccacctcggccctggatccggagctgatcggggaggttttggaggtcatgaaacagctggccgctgagggcatgaccatgctggtggtgacccatgagatgaaatttgccaggaatgtgggtacaaaggtggtttttatcgacaaaggggtggtagtggaagagagcgcgccccgggaattttttgaggctcccaggaatgagcggaccagacagtttttgggctccgtccggtgggctggctgagaggtgaaaaggatatgaaaaaaactgagttcaatgtaggaaagcggaaaatcgggcgggcgctgctgatggtattggctgccgcggggctggcgtcgggatgcaaaagagcggaggcggcgcaggagcgcggcgcctccccggcccgcgaagagattccggcccgcgatgggtccccggcccgcgatgggtccccggcccacgatgggtccgcggcccacgatgggtccgcggcccgcgaaccatccgcggccgccctgatatctccaggtccccaaatccagcgtctggaggacggcttttccgtggtgggctacgatggggactactggtttgaccagtttctggaagcgggaggcgcagcgtcggacggcggggtgatcggctttttagccgggcggttagaactgacggaagccgggatcgggttcgcggcggagggcttcggttgcagcaccctggcggccagaagcccggagggaagcgccctgttcggaaggaatttcgactgggagagctgcgaagccctggtggtgcggtcaggtccgccaaagggggaggggagttacgcctccatctccaccgtgaatctggactttatccgcgccggttacggctccgggctttcgcagctgccggaggaagtacgcaccgtgatcgccctgtacgcccctctggacggcatgaacgaccagggactggcggtttcggtgaacatgatccaggaccgggcgatcatcgaccagaacacggataagccggacctgaccaccaccacggcggtccgcctgctgttagaccgggcggcgagcgtagatgaggcggtggcgctgttggagcagtatgacctgcacgcttccatgggtgtgatggtccatttcgcgctggcggaccgcagcgggcgcagcgtggtggtggagtacgtggacaaccgcatggttgtgaccgaaacgccggttgtgacgaatttttatctgtcgccgggtgaaaaacaggggatcggaaccgcccagtcccacacgcggtatgagattctgacggagcgcctggccgtgggagaaactatgacggaggatgaggtgcgcgacgccctggacagcgtcagcaaggacaatttcggagaatttgagtccacggagtggagcatcgtattcaatctggacagcggggaagccagatattaccaccgggaaaattatggaaccggttatcggttgaatgtaaaggattgagccaataggaggttgtgatgaactattttaatttgctgtggagcctgtatcagctgaaacagaatgcgggaaagagccgggaagcgattaagaagcttcaggaaaaaaagctgagaaagctgctccttcacgcctatgaccattcgctctattaccacagggtgtttgaggagacggggatcacaagagaacagattccggtgctgtccatttcctcctttccgacgctggataagcagcagcttctggaacattttgatgagctggtcacggtcccggaattaaaacaggaggacctgcgccgatttgacgccagcgaaagtccggaccggaaaacctttcagggaaaatatcatgtagtccactcgtcgggcagcaccggcgcgccgggatattttatctacgatgtggcggcttggaatcagatgctgttggggattatccgggcggcgctgtgggatatgaccatgccggaaattttgaggtttttgtggaaagggccgcggattgtgtacatcgccgccacagacgggcgctacggcggggctatggccgtaggggacgggatcgacggcgttcacgcccatcagcttttcctggacgtgaagactccgcttgcggagtgggtccgtcagatccgggagtttcgccccaacatggtcatcggatatccctcggccatcaagatactgggggagcttgtggagcgcggcgaggtggagctggacgtgttccgggtggtttcctgcggggaacccctgggcgccggcctgagaagctatttggaggaaaccttcgacacggatgtggtgaacatttacggggccagcgaatccctggccctgggtgtggagatcagccacgaggagggaatgttcctctttgacgacttaaactatatcgaggtggaggacggctgcatgtatctgacctgtctgtacaattttgcccagcccctgatccgctactgcatctccgaccagctgaatttaagggagccggaggcaaaggatttctaccccttcaccatggcgggaaatattatggggcgcagcgaggatctgatgtggtttgaaagcccccggggggaacgggatttccttcatcccctggtgatcgaggggttttgcctggaggggcttctggattaccagttccgtcagctgggcccgtcgtcctttgagatgctggcagagctgtccgacggcagaaaggcccgtttcatccactcggaaatgttgaggcagatggggcagatactgaaggaaaagcgcctggactatgtgcggttttccgtccgctttgtggatgagatccgcccggaccggggaacggggaagaaacggctgattgtggcctgaaacaccgcgggaaatggaggagtaccctttgaaagagattttgctaaccgccagggatgtttgtaaaacatttgagacaaaaaagaaagaggtgcttgttttagatcacgtatcggccgacatctgccggggggatttcaccgtgatcatggggccgtcgggagccggaaaatcaacgctgctgtacgccctcagcggaatggacggaattacctccggaaaggtgatctataagggcagggtgatcagcagtttgaatgaaaaacagatggcggatatccgcgcccgggagtttgggtttgtgtttcagcagacctgcctggtgagcaatctgacgctctttgaaaatgtggcggtggccggttatctgggagatagaccggcggaatctgaagtccggcggcgggcagaggagcttttggagcggatgaacgtgggagacgccagggaccggctgcccgcggaggtttccggcggggaggctcagagagcggcaatggcccgggccatgatcaaccggccggggctgatcttcgcggacgagcccacaggggcgctgaaccggaaaaatacccgggaggtgctggggcttctgacagatttatccagggaggggcagagcattctgatggtgacccacgacgtgcgcgcagcggtccgggggaacaggctgatctatctggaggacggaaaaatcgtaagcgggctggagctgcccttctttacgccctcggaggaacgggacagggagagccgggtcaatgactggctggcttccctccggtggtaggaggtgagacggagtggagttccaaacagtgttaaaagcggatttgagacagcacagaggcggccttgcgggaatttttctgctgattttattagttttctccgccctgggcacggtgttgtgcgtatgggccaattccggggattacattcgccgggaaatacgccgggcgggatttggaacactgaccgcctgggtgtccggcgtcccggatttggcggaattgagcgccggtataacggcgttcaatcaggtggagcgggtggaggttcaggagatcgtctacggaaattacgccgtaaacgggcagaaatccgacagcgagggccagctgattgtgtggaacgggggtgaaaaccggtaccgctttttgacagacgatctctcgggccgccgggaagcgccggggaagatcgcgccgggggagatctgggtttccccgtccctggtctccatgtttggcgttggggttggagatgagatcacatttcccattgcgcgttccgggacaacggtggggtttacggtgaagggattttacgaggacccctttatgggcagctccatgatcggaatgaagggctttttgatcggcagggaggattaccggaggattctggaaaccgttcgggagtccggcatcgatgcgcttgcaagggacggagccatgctccacattttccggcaggaaggtgtgaacgtcacggtttcggaactgaacacactcttaaatgagcggaccagtctggcggaatacacggagtttgtgcacagcgaaagcgccattgccggatttatgctgattttgcagaacgcctttggcggtctgatgaccgcttttacggccgtgctgctgtttgtggttatgattgtgctgggccacagcatcagcagctccatagaaggggattttcgggatatgggaattttaaagaccgtgggatttaccgggaaaaagctgcgggggatccagacggcgcggtatctggctgtgatcctgccaggaatgacggcgggtctggttttttctctgttcctcggccggatggtgggaagggcgacgctcacaaccaccggagttctgatccccacaggtctcccggcaggaccggtgatcctgacctccggattgatccttgtggtgctggctggatttattgcgctgaaaaccaggaaaatcaatgggatttcgcctatggaggcgatccggggggctgagccggccacctatggaggcaatacggcgcgataccccttacgcgcccgctgcctggaggccggcctggccctgcggcagctggagacggggaagcgcaggtacgccggggcctgcctggtggcggcgcttctggtatgttccgcctcagtggtcgggcgcatggactcctggctgggcgcggacggccaggggatgatgagcgcgttcaatccggcggatcacgatatcggcattcagattctgggcaggcgcacggcggaggaggcggagcgcaccgtccgctcctacacggaaatcaccgaccgttatgttctggccatgcagggggtgtccgtaaacgggatcgactacacggccaacgtcatttcccagcccgggcggtttcatatccaggaggggagaacctgcctgggggatgatgaaatcgtgctgacggaatttgtggcgtcggacctgggcgtgtccgtgggcagcaccgtcacggtgcgggcggacagcggcagcaaaacctatacggtgtccgggatttattcctgcgccaacgacatgggcggcaacgtgggaatgagccgggagggttatttgaaaatcggccgggacaatcctgatatctggtgttaccactattttctggaggacctgtccagaaagggggaggttctggaggcgctggagacagagtacggcggggacgcttatgtccacgagaatacgtggccggggctttccggcattatttccgccatggaggcgctgctggtctttttgtacggtatgatgattgtgtttattatggtagtcaccgccatgaccggcggcaaaattctgtccgcggagcaaagggacattgggatttataaggccgtgggatttaccagcggccggctcaggctctccttcgctttgcgctttgggatggccgcggccctgggttccggtatcggagcggctctggcggctgcgctgaccgatccgctgatatcatctgttatgaagatggcgggcatcagcaattttacctccacggccacggtcggaaatacgttgtttccggtggttacggttattctgctctttgccggattcgcctgggcggagtcgcggagtataaaaacagtggatttgacgattctgatggccgaatgagaaataaatacgcttgtatgcgtccgggacagggcgcgggaaaggatgataaagaatgatgaatcaaaacagacggaaacagatttaccggatcattgccgccgcggcgctggccgccgtgctggcgggctgcggccggtcggagacggccggaaggcaaaacggcagcgcagcgacgcagaccagcgtgagcggcagcgcagcagccgggaacggtgcgaacggcggggcgcagactgagtccacagtgagcggcaatatcgttacggctggcactggcgcggcggagaaatcccaggctacggcgggagccgcgcggctggaggtccggtttggggacagcggggagccctttgtgcttcagatggaggacaacgctactgctgcggctattgccggttatgtgggcacctcggattggaggctgccgatttatcactacgacgattatgagaactgggaggtcatgcagtattacgacatccccagccggtatgaaattccctccggcgctgtaagcgtaacgtcggagaaggccggggaggtgtactattccgagccaaaccggattattctgttctacggggacgcggatatttccggggaatacacgaagattgggagtatccaggattcagaggaattccggtccgcggtggagaacaatcccgttctggagggctggagcaataaaattgtacggatcaacagtatggattaggatcacgagaacgtgaaagacgccatgataagcgtcagcaaaaacaattttggggagtttatctcaacggaatgaacggtagtctacagtcagggcaacggagagatccgctattaccgccgggagaacgatgacgattattacggctttgccatcgggccagacagttgagctaaggacgggagatatgttggaaaattacttattgaagggtttgatcatcgggattgtgttcggtgtgccggcaggtcttgtgggtctgttgtccatacagagggggctgacccagggcccggccgccgggtttttcaccggaatcggctcttccgtggcggatgtgttttacgcctgtgtggggatattcggactcacttttatctcggattttttattaaggcaccggagcgttgtctgcggggcgggctgcctgatggtgataggaatgggattttggggtttttggactgcggggactgaggcggccccgcagtccgctgtggcgcggccgggggagagccggcggcttttttcctgctttttctcctcctttaccatcgcgattaccaatccggccacgattttgtcctttatggtggtattttccatgtttgggattgaggggatggaatccccaggggcgaagctccagctgatcggcgggattttcggcggaacctgcttctggtgggctgccatcgccctgatggtgagccggtttcggagccggattacgacgggattttacgggaagctgaaccggatattcggggctttgatggtcctcatgggagcgtttattggaatccgcacgtttgcgctttaaacggcgccagcctctttgtggaaggcattctgcacctgtttcagaaaccggtccgccgcgccggaaaagacctggtactttttccacacgatatccagatggacctccagcctgggttccagcggccggaagcacagagggctttcctcggaggtattgaccagcttgtcaaggcacagagcgtaccccatgccggcggccaccatgagggaggcgttgaacaccagattgtaggtggctacgatgttcagtttctcgaagtccttacccagccagccggaaaattcattgctgagcaaagactgccgggaggtgatgacgggaaggtcccagatgtcccttggacggatcacgggctgggcggccagaggactggtcttgggcatgagaagcccccaggtgtcggtggcgggaaggcggatgtagtcgtacttcttcatgtcggccggctcgatgagaatgccaaaatccagcagccctttatccaggcgctccgtcacgtcgtccgcgtttccgctgaataggtggtagcggatattggggcaggaacgctgcaaatcggtggcgatccgggcgatcaggctcatggcgtccgtctcgccgccgccgatgcagatatcgccgctcaccacctcgtccggggccatgagctcggcttccgtcttttccaccagatcgataatctcagcggcccgtttgcgcaggagcattccctcctccgtcagggtgattctgcggttgccgcggatcagcagtttctttccaatctcttcttccagatccatcagctggcgcgacagggtgggctgagtcatatgcagggactcggctgctccggaaatgctctcttccctggtgacggccaggaagtatctcaatacgcggatatccaatctcatttcccctttcttttataatccagtatgctttgccggattgtgtgaccgctttcatcaatcattatatatagaataattcatgcttgtcaagtatgggactttatttaatataagtatttgatataaatacaccattgaattacaataaagacacaaggagggaacgcgatgaaacatttgtttggaacaatgcttatactcatgacggccgccctgattccaggaacggttctggccgggcagtggaggcggggagactccctcaaccaggttcgcgaagagaccggacccgccgccggggacggcaaaacggcagtgggggcggatggagaagaaactatgataccgatgacaatccaggtgggagatcagacctttgaggccgctctttttgacaatgaggccgcccgggccctggccgcgcagctgcccatgactgtgttcatgaccgagatgaacgggaacgaaaaatattactacctgcccgaatccctgcccgcggcttctgagaacgtagagaatattcataccggcgacctgatgcttttcggtacggactgcctggtgctgttctacgaggattttcaaacctcataccgctatacccggctgggcgctgtctcagaccccggcgaactggcccgggccctgggccagggggacgcggcggtgtccttcggcctgagcgggcagtgacaatcattaaaaatatgattgaagaaaaggagatttgaacaatggaaaaacagatgctgaaaggaaaagtcgcattgatcacaggggccagctacggcatgggccagaccatggcggagcttttcgccgaggagggggccgcggtggcgctgaccgccagaggcagggagacgctggattccgtggtggagggcatccgcgaaaaagggggcagggccataggcgtgaccgcggacgtctgttccaaggaggataccaggagggtttttgaggagacggttaaggccttcggaaccctggatatcctcatcaacaacgcagggatcggggagcagaaaatgatcgacgagacggaggacgactggatgctctacgtgatgaacaccaatctgggcgggccaatgcgctacatcaaggaggcgctgaaaatcttcctgcctaaaaacgacggcgttatcatcaacatttcctccgtcaatggcgcccgtcccttctgcggggccacctacacgtccaccaagggagccttgaacacgctgacaaagaatgtggcaatgcgcctcgtcgacacgaatatccgttgcaacgcggtggcccccggcgcaacggtgacgccggcgcatctggccaataaaaagggcgagcagccgggaggcgcgaagatgctggaatacagcggccactacgtgtatttccccgggccggagtgcgatcccatggaccaggcctacgcctgcctgtacctggccagcaaaatgggacgccatgtaaagggccaggtacttcaggtatgtaacggcgcatttctgtaggaaaaaatgtcgcatgaacacaaaacaaccataaaaaggaaagaggttaagatatgaacgcatttaatattggtatgggattaccttatactcgaatatgaaagaggtggaaacatgggggaatacacagataacgtccaggcggtcatacaaaatcttcgggacgcagggtgcggcagagagaccgtggagcagttcctggagctttgcaggtccggcgagtgtaagaagcagttaggattgctggaaaagcaccgcaagcgcctgttggaggagattcacaaatatgaaaaacagattgattgtctggactatctgatattccagatgaacagagagaaccggattgtacgagagcgatgagaggagaataagacatgttaggaaatttcagctattgtaaccccacaaaactgtatttcggagcggattcgctgagcaatttgagagaggaactccctaaatatggaaaaaatgtcatgctggtttacggcggcggctccatcaaacgaaacggtatctatgatcaggtggtaaagcttctggacgagggcggcaagaacgtttttgaggacccgggcgtcatgcccaatcctacggtggaaaagctttacgagggctgccgcatcgcgagggagaaccaggtggatctgatcctggctgtgggcggcggctcggtctgcgattacgccaaggccgtgtccgtttccgcccactgtgaggaggatccctgggaaaaatactacctgcgcatggaggacgtggataaccggattatcccggttggctgcgttttgaccatggtgggaacgggctctgagatgaacggcggcgcggtgatcaccaaccacaagacgaagctgaagatcggccacgtgttcggagaaaatgtatttccgaagttttccattttaaacccggcatttaccttcaccctgcccagatatcagatgatcgcgggattttacgatattatgtcccacatcctggagcagtatttttccggggaggacgacaatacctccgactatatcatggaggggctgctgaaatccttgatccacagcaccaggatcgcggcggaacatcccacggattacgaggccagaagcaatatcatgtggatcgccacctgggcgctcaacacgctggtggccaagggtaagaccacggactggatggtgcacatgatcggccagtccatcggagcctacacggacgccacccacggcatgaccttgtccgcagtctccatagcgtattaccggtttatcatgccttacggcctggcgaagttcaggcgcttcgcggtcaacgtgtggaatgtgaacccggagggaaagagcgacgaggcggtggcggaggaggggcttgcgcggatggagaagtacatgagagagctgggccttgtcatggacatccgggagttgggcgtgagagaggaaatgctggatggcatcgccgcgggcacctttgccatggacggcggataccgggcgctggatcacgatgagattgtggaaatattaaaagccagtatggcgtaaaggagaaaattaattatgggtaagaaggttcttgttctgtccaccagcccccgcgcgggcggcaattcggagatactggcggacgaatttatgagaggtgccgctgaggccggccacgacgtgaaaaagatttgcctctatgacaaggaaatccgcttctgtaaaggttgtctggcctgccaggttacgcaaaaatgcgtgattcacgacgacgctgaaaatatcgtggcgcagatgaagcaggcggatgcgttggtttttgccacgcccatttacttttatgagatgtcgggccagatgaaaacgctgctggaccgcaccaacccgctgttcccggcgaagtacgcctttggcggcgtctatctgctggcgtcctcggcggacggggatgcggcctccatggacggggcggtaaagggactggaggggtggatcagctgttttgagcaggcccgtctggccggagtggtcaggggaaccggggcggatgaaaagggcgcaatccgggataacgcaggtgcgttggaggaagcctatgagatgggaaaaaatgtgtaggatttcggaaaatgggccggggccgcggcagttgccgccctccggtccattggcgtgaaaggaggatttgaaccttgaaatatgattttgacagattgacggaccgcggagataccaattccatgaaatgggatgtgccggagggccagctgcccatgtgggtggcggatatggattttgagactgccccggagattgcggaggcgatccggaaacgggcggcccatgggattttcggctatacggtggtgccgcaggcctggcggcaggctgtggccggatggtgggaacggcggcacgggtttcccatggaaacggaatggctggttttctgcaccggggtggtcccggctatctcaagcgcggtccgcaagctgaccacaccgggggagaacgtgttggtgcagactccggtttacaatatctttttcaactccatccgcaataacgggcgcaatgtggtggaaaaccggcttttgtacaatggccggaattaccgcatcgattgggaggatctggagaaaaagctggcggatccccagaccacgctgatgattctctgcaatccccacaaccccaccggctccatctggtcccgggaagagttggggaggatcggagagctctgcgcgtccaaccatgtgcgggtcctgtccgacgaaatccactgcgacctgacggagccgggatatgagtacgtgcccttcgcgtcggtgtccggggactgcgcccgcaacagcgtgacctgcatcgctcccacaaaaacctttaacctggcgggcctgcagaccgccgccgtggtggtgcccgacgaggatctgcggcaaaaggtggaacgggggcttaataccgacgaggtggcggaacccaatgcctttgcaatcgacgcggccattgctgcgttcacaaagggggaggtatggctggacgccctgcgggaatatctgtcccaaaaccgccgggcagcggaatatttcctggaaaacgagatggagggcgtatccctggtatccgcccacgcgacctacctgctctggatagactgctcgcgggtggccggcgatgcactggagttgtgccattatctgcgaaatgaatcgggtctgtacctgtcagcgggaatcacctacggcgaaaccggcagacagtttttgcgtctcaacgccgcctgccccagggcgcggcttctggaaggacttgagcggctgaaacaaggggtggctgcctatgaggcgcacgtgaaccggagctgttgagaagttcacggaagctcacgatttaattgtatctttccctcccctatgctatactaactttgatacctatatgaacagagttggaatcacgcaccgcatccccattttttacagcgccataaaacgggcggctatcccgtccggccacgggtgggggacgttatcggagaggtgcggaacaggaagggatattgatttgatgaagaaaagcctatgcctgctgctggcaggttgtttagcgtgcgtgcatctgtcgggctgcagcgggaagaaccaggtggtgaattaccaggatacagaccttcctgtcacgacgattacattttttggaaataaatacgagcctgagaacgtccgggtgatcgaggagatcatcaccggattcatggaggaaaacccgaatctgcgcatctcctacgagagcctgaagggggctgaatatttcaaggccctgcgcaagcggatggcctcgggaaagggcaacgacgtgtttatggtgaaccacgacgtgctgctggagctggagcggagcgggcaggtggcggatttgtcgggcttagagagcatcggccgctacagcgacgccatgctcagccagatggagattgagcacggaggggtctactgggtgcccaccacggtgtccatgtttggtctttactgcaacctggatgtgttaaagaagcacaaacaggaaatcccgcgaaacctgggagaatgggagcaggtatgcgattactttgtgggacgtggaatcacccctattgtggccaataatgatatttcattgaaaaccctggcgatcggcgcagggttttatcccgtttatcaggagggccgccagacggaagcgtttgaacggctaaacagcggccgtgacaagctcagcgattatctgcggccgggcttttcactggccgaatcgctgattgaacgggggtatatcgatgcggcgaaggcggccgcgaccagaaaaacctcggacgatttggaggaattcgcccggggagaagcccccttcatgcttacgggggcctgggcggccggacgccttgaggagatggctccggatctggattttgaggtgcatccccttccggtgctggaggacgggccgctgttggtgatcaacgcggacacgcgcctgagcgtcaaccggtccagcgagcatttggacgacgcgatcaaattcgtggagtattttacaagagaggaaaatattctgaaatttgcggaccagcaagcctccttaagcccccttgtgaacagcccgcccacttccgtcaaggcaatccggcctttgatcccctgttatgaggagggacgtgtggtgtttggagccgacgccgggctcagtatcccgatctgggatctgaccgcggaggtttccgccggactgctgtccggacagacgttggatgaggctatggcctggatggacgaacaggcaaaggagggattggaaccgtgaataaagaaaattccggcgcttcaaaaggaaagatcgcggctgcggccgcgattgtgggggctgcacttgccgccctcacctgcctgtttttggggacggtgcgggaacagctttggcagcagtccatccgcaccattctggagagtacgcagcagggatgccttacgctgcgggtccagctggaggatgagtatcgtatgctgggcagagtcgccggctatttgaacgaggcggggcgggttgaaaacgtggacagcctgctccgggattatgtgcaggtggacgaaggcgtggtgctgtacagtggcgacggcgggcgcctgccctacggagcgcaggcggatgaggccgtggcccggatcctggcagaagatagccgggattacggtattcttgaaccccatatcagcagcgcgaccggagtcaatgtgttcaatctgtttattcgcctgaccatggcggatggcacggccgcgtacctggtgaaggagtacgaggtggattccattgtggacagcttcagcatctcattttatcagaacgcaggattttcctatgtggtggattccgacggcaatgtcctgatccggccgccccaccccaacagcaacaaaacggtacagaacctgttcgacatcctggaggaatcccccaacgatccctcaaaaatgcaattatttgtggattccctgtcaacggagaaaaccggctgggcgactttttcgtatcagggcgaggagaccgtgttctgttaccttccgctgaagctgggatcggactggtatctgatatccatcatcccccgggcggtggtcagcgctcagaccaaccagatcattcagcgcaccctgattctgatcggagcgattatcgcggggatcgtcgggctggtggcgctctatttccactatgccaaccgggcggccgggaagctgcgcaggcaggcggattacatcggacatctgtacaacgcggtgccggaggggatcgcccttttgaccgtggaacgcccttaccggctgctggagctgaaccgggaaggatcgcgtttgttaaacgcacccgctaatggcccgggaggcggttcgcaagtgcggagtctggaagaaattctgtatctggaggactataaacggacggcggacctctttcgggaggccataagctccggccggaaaattccatttgagagccggatggtacgcgcggacgggagcctgttttgggcctccggcatcgcggagcgggttttggatcaggatggaaaggagattctcatcgccacctttcacgatattacggcggaaaagctggctgaggaggaggcggagcgggagaagcttcaggagcgcaggatgctggtgggggccatatccaacgtattccccgtgatcatcagcctgaatctgagccgggatacgctcaaattcatctatctgcagcgggggcttatggtgaatatcagggaggacggggcctacagccagctctatgagagctttatccccaccgtgcacccggacagcctggaggagttcaaacgccgcttttcgctggagaatctccgccgaacgctgggcaaagagcggccggaggtgtttatggacacccggcagatgctgacggacgggcagtaccactggacctcgattcagatcatctacgtggacaatccctactcggaggacgatctggcgatccttctctcccggcgcatcgacgagcagcgctatgaggaggagcagaaacgccaggcgctgcagagcgcgttagagggagccagggcggccagcatggccaaaagccagttcctctccaacatgagccatgatatccgcacgccaatgaacgctatcatggggatggcggctatcgcgtccacccggctggacgaccgggtccgcgtggcggaatgcctcaaaaagatcagcctgtccagccagcacctgctcagtctgatcaacgatattctggacatgtccaagatcgagagcggaaagctgtccctgcgggaggaaccctttaatttcgcagagctggtggcgaatgtaacggagcttatggtcccccaggccatagccgcgcagctcgaaatgaatgtcagcctgccggtgctgagccaggaggaggtggtgggggacgcccttcgcgtccgccaggtgtacctcaatattctcagcaacgcggtgaagtatacggaggcgggcggccgcgtgcagatcgaagtctgggaggagccgggcagccgcggagggcgaaggaacttctttttccggtgcacggacaccgggattgggatgagcggggaatttctggagcatctgttccagcccttcgaacgggccgcggattcggctgacaaggcgtcgggtacgggtctgggcatggcgattaccaggaacatcgtggacctgatgagcggcgatatccaggtggagagccgtccgggggagggttcccggtttacggtgatgctgcccctgcagctgcagaatgccaggcaggaggatgtgccggaggaatggctgggcgtccacagcctgatcgtggacgacgaccggcagacctgcgagaacgccgccgccctgcttgaggacatgggcctgcggccggaatttgtcacggaaggggcggaggcggtttgcagagttatccaggcaaaggacacgccggatccatttaccctggtgattatcgactggaagatgccggggatggacggcgtggaggccaccagacggatccgccgggaagtgggggatgaaattccggtcattatcctgactgcctacgattggtccgagattgaatacgatgcccgggaggccggggtaacggcctttatctccaaacccttctaccgatccaagctctgctatctgctcaatgagatcagcggagagaccttggcggaaggccaggacgtatctcccgtccgggattacgggggccgccgtattcttttggtggaggacaatgatatcaaccgggagattgcccgcatcctgctggaagagcgggggatccgggtggaggaggcctgcgacggcgcccgggcggtacagatggtttcggaatccgcgccggggtattatgatatgatcttcatggacgtgcagatgcccattatggacgggtacgaggccaccagggccatccgttccctggaccgtgcggatacggcccgcctcccaatcgtggcgatgaccgccaacgcctttgacgaggatgtgcggaccgcgctacgggctgggatggacgcccattttgccaagcccatcgagatcgccaagctcgagcagatgctgtaccggtatttgtccgaaaagtaagcggaggggtttatggagaaaagcagcggactttatttgctggtttacgatttttacgaagcgcggatccggtttggtttttaccggtatggggactgcctgccgtcgatcccccatatctgcggcgcctttcacctcgggcgcgctacggtccgcgccgcccttgccctgctggaaacggaaggctacgtcgaaaatcaggagcggcgtgccgcccgggtgatctatcaggcggatcataagcggtatgctgaaaacgcccgggattactacgtgcccagaaaggacggtctgggggaaatgagggaggccggatatctgttaattcagcctctctgggaggcgggagcgcgcagatggaaccaggaacggtggaagttttactgccggaatttgagcggcattctgccgggagacccgcctccgtccatggagctccatctcctggcgcttatggagttaaacaaccagctgcttctgaacctgtactgggaggtgcttcgctacatccggatgccctctctggtggaccggggaaaaatgaaaagcccgattaccccggatacgatccgggaggggctggacagcggggacgtggtggcctggatgaacaaggcgatccgggatgtttatgtaccgctggaggagaggatgttttcgtttatccaccgggagatcgcggcccggggagcggaggaaattgcggcaattccctttcagtggaatatataccgaaaccggccgcagatgcgttataccctggcttccatcctcatccggaagattctgtacggcgtctatccggtgggaagctatctgccctcactgccggagctgtcagagcggtacggcgcctccctgaccacggtgcgccgtaccctggccctgctggaggagctgggcgtcacggaatcctttcagggcaagggtaccctggtgtgcatgaagcggaaatcaccggatcttgagaaagccgagattcgggagggcctgcggctgcaccgggaaagccttcagtttctgaggcttaccatccggggggtggccctctttacgctggagcgcgcatccgccgggaaacgggccgcgctggaggcgaggctgcgcgggatgttggaacaggggcacagctatcgctgctttgagaccatgctgatgtttgtcaaagaggagtgccctctggcgatggtccgggaatgctacggaaggatcgcggatctggtggcctggggatacccctttgcccgtctgatgctgccggagggggagctgggaaatgcctatgcgttccgggtggaacagatggcggactgcctttgcagggaagattttgagggtttctgcaatcagtgggtcgcccttttagagcaggaggaggagaaggtttcaggactcgggacccagccgggcagctgttagcggtgggcgttttgcgctgtgcggataagcgggatagtggcagcggaacctgtgtccgcagtagaaggaagccattttaccgatacaaaaagtgattgagcgcagatggaaatatccgggagcggtcgattcaaataagctgttacacgggtttttccgtcagccgtttcccggctggcggttttcgtttcagggacaaatgccggaattcccaatatgcaggggctacacggggaaatgcaatccacaggtagacaatcaaaagagggagtgttactattaaaggcatgaatactgggagaccaagggcatcattgaggaaaaatatccgccgtctccaggagaagaagcaggagccagcggagaagattcccggcggtgagggcttaaaaaacgagggcttcagccgggaagagctgatggaaatttcacaacgacgaggaggaaataaatggaaaatcaacagaacgggcacaagcggcgcgtccgctattccggcacgcacccaaagcgctaccaggagaaatataaggagcttcacccggaaaaatactcggacaccgtgtccaaggtgatccagaagggcagcaccccggcggggatgcacatctccatctgcgtgaaggagattctggactttttgcagattcaacccgggcagaacgggctggacgccactctgggctacggcgggcatacgttggaaatgctcaaatgcctggaagggaaagggcatatccacgccctggacgtagaccccatcgagtcggagaaaacaaaggcccggctggccgacctgggttacgggccggagattttaacggtgcggctgcaaaattttgcggagatcgaccaggtggccgcggaggcgggcaggttcgacttcgtgctggcggacctgggcgtgtcctccatgcagatcgacaacccggagcggggctttaccttcaaggccgaggggccgctggacctgcggatgaacccggagcgcgggatcagcgccgcccagcgcttgaaggagatcacgctggaggaactgacgggtatgctcaccgaaaatgcggacgagccctacgcggaggagatcgcccgggaggtgacggggcggttgaaacggggcgaggagatcgccaccaccacgaagctctaccaggtgattggggacgccctggctttcctgcaggaaaaggaccggaaggaggcggtgaagaaatccagccagcggaccttccaggccctgcgaatcgacgtgaacaacgagtacgaggcgctgtacgcatttctggaaaagctgccggaagtgctggccccgggtggccgggcagccattttgaccttccactcgggggaggaccggctggtgaagaagtcttttaagcaatataaaaaagaggggcgttacagcgatatctgcgaagaggtgatccggccgtcccaggaggagtgcgcccgcaacagccgcgcccgttccacgaagatgcggtgggcggtgcgggcggagtgaggaagcgcggcgggcgctgggccggcggagattccggcggagcggggagccctggggaggccggggagattccggcggagcggggggagtcccggcatgaaaacaggaaaagaggaactcagaacatgggaacattatacggaatcggcgtgggtccgggggacccggagctgctgaccatgaaggcccaccggatcctgcgccaggcggatgtaattttctgcccggagaaggaggagggggcgggcagctttgcctttgacatcatagaggaactggtaaaagaggcgaaggcggagatcgtgaatctggtctaccccatgcattaccatggagagaagctgcaaacgatgtgggaaatgaatgccggggtgatcgcggaatacctggaaggggagcggaccggcgcgtttatcaccctgggagacccggcggtttacagcacgttcatgtacactctgccgtatattgagcgccgcggggtaaccgtggaggtggtgcccggtattccctccttctgcgcggtggcggactccatgaagatgccgctggcggcctggagcgaggacctgttggtgatgccggtgggcaggaagggcggcggggacctgggggagattctgagacagcacgacaatgtggtgttcatgaagccctcggccaaccaggaggccctggtccgggccatacgggagaacggcctggaggacagtttcgtgctggtcaccaagtcgggaaccggggaggagcggctgatcactgattttggagagctggaacagtacgatattccctatctctccacggtgatcgtaaagaatccccggaaacggagggggtaggcagggaaacagccacacaagcgaaccggcgaaaggagggcgctatggattacgtggatttaaaaaacaagctgaccggcatgttcgacgccgggaaattgcaggcggctcccggagagtggggatttttcaatgaaccgcggcgggaggtccgcacagtggggtacgccaccaatctgaccggagagattatccaaagagccggggaggccaaggtggatttcctgctgacccatcacgattcctgggaatttattttcgggttgaaggagagctgcaaccggctgctggaagagctgggaatcgcccacgcttttttccacgcgccgttagacgacgccggattcggcaccagctcgtccctggctgccgctttgggcgtgaaaaattgtcagaaggtgatgccttacgcggaagtgtttttcggcggtgtggcgggcgatgtggaaccgggcagcttcggccttttcgcagaaaagctggaacagattctgggcgagaatatccgctgctaccaaaaccacgaaggtcctgtccgccgggtggccgtggcggccgggggcggcaatatgacaaatgagatgcgcatcgccgtggaaaacggctgcgacacgtacgttaccggggagtatgtactgtactcccagcagtacgcccagcatgtcgggatgaacctgttggtggggagccacaccaacacggagattctgggcgtggaagccatggcgcagcggctggcccggggaaccgggctgaagctggtgcggatttcggaacccaattactgagtgtcccgcgaacgaccgcacagataagcggggaaaatgcgccgaaaaggttgccgcctttatggctatgccgcgtcaggccgcgctttgccgggggatgtccgccccgctgcacatttgttgactgcccccatggcgtgtgatagaatgggattagcagttgtgcgtaccggttttgacaatgggggcgagatatgagagaactggatgaactgaaacaggaaattgaccggctgcggttgctggcgcagcgggatcccctcacggggcttttgaacagaagcgccatggaggaacaggtgaaccggcttttggaggacgagccagccggtctgtttgtggtgatggatgtggacgagttccgctatatcaacgatcaatacggccacccggccggggatatggctctgcgggagctggcccggctgttgggggattctttttttgccccggccctgtccggacgcgtgggaggagactccttcgccgtatttctgccaggcgcctgcgccggggagacggcggtaaacaagatggaacacataatgggcggcctggcccgggccggggaagcccttggtttgggaaaccggctgcgggtctccgccggggcggagtctgcggggccgggtgataggttttttgatttgtacgagcgggcggacgccgccatgcgggccggtaagagcgaacggaaaaaggccctctatttttatgagccgtccatgaagcaggggacagacggcccggggacagaggatacggagtcttcggcggatatgaagtacataagcgagcagctccgggagagccatattgtggacggggcctactgtcaggattacgacacgtttctggcaatttaccgctttttggagcgggggctgagccggaccggcatccgggttcacctgattctgatctccctgaccgacctgcacggcgcctttgtgcggctggacgagcgggaattactgatggagcgcctgcaggagagcatccgctcgtccctgcgcttcagcgatatttacacccagtacagcagctgccagtttctggccatggctgtgtgcgccgggcgggaaaatatggatatcatcaccgaccggattgagaaggcgtttctggtgcgcgagccggaccgcccggacatccggctgtccttcagcttttaccccctgcagcctatcccccacggcgtcccggcagcctctctgtttgggaagcgcccggtggaggatgagagccgggatatgtgccaggggactgaaaatcacgaatagcggaggattagagaatgtcaaatgaaacggaccgggcggcgcagcgcgttcacaaggcgggcgcagtgcacagaaaatcgatttcccataaagtgtgtttcagccttctggcgattctgatccctgcgcttgccgctctgattatcaccgcctgtattgtgaccgccggagcggtcgcggaactcaacgaagaacttctggacctccagacggattacgcggtgtccagggtagacgatctgtttaacggaaagctggcggctgtcaccatgctcgacgagagcagtgagctgcagcagtatttccagtccgtttcaagccgggaggacatcgcttcctacgggaacctgagcgatgtcctggacgaactctcaggcgcgctcaaacggatggcgtccgggagcgtggcgcaggtctgggtggcagacgagcggacagactgttatctgctgtccgacggacgtgtggcgaaggcgaagctgaaggaaacggaatggtacgggcctgtggtggaacagcggaccgctctggtgacggatccctttctggatcccgtcagcgggagggacgtggtttctgtgatcaccccggtctactcgccggacggaacgcaggttttggggacggccgggtttgacatctatctggacgatctcagccggatgctgtccgccatcaaggtgggaaagaacggctatatggagctgctctccggtaaatcggactatatctgcagcgacgaccccaccgccattggccgcaacgttatggagctggatatcggggaggaatacaaggaaaaggttaccggcaagtacaatggagttctgaatttcagctatcagggcgtcaaatacacggccatgttccgtaacagcgagaccacccaatggctggtgattgcgaccctgcccatgtccgaggtcaccgccacccgggacggcctgatcaccgttctggtggcgctggccgtgctcacgttgattctgatttccgccctgatcgtggtgatgatccgcaggctgttaaagcctctgtcggagatcagccgtggaatggaggaactttccaggggaaatctggaagttgagatccgggcgggaggggacgacgagatcggcctgctggcggagagcgtgcggtcctcggtccgctcgctcaaggccatcatcctggacgtgtcccgcatattaggcgagatatcggcggggaatttggacgtcggggtggaaggcgactatattggcgatttccgctttatcagggaggcgctggagcagattctgggtgctttcaactccatgatgggccagatcaatgtgtccgcggaacaggtttcctgcggttcggagcaggtatccgcgggggcccaggccttgtcccagggggcttcggagcaggctgcgaccgtggaggagctggccgtgagtatggacgatattacacggcagatcgccgccaacgcaaaacgttctgcccaggccggaagccgggccaccgccgtgagtatggaaacggtggagagcaaccgtcggatgcaggagctgttggaggctatgggggagattcgggacagttcccgcgagatcgccatgatcgccaaaaccattgaggagattgcgttccagaccaatatactgtctctcaacgcgtccgtggaggcggccagagccggggaagcgggcagaggatttgccgtggtggcaaacgaggtccggaacctggccgtaaagagtgcagaggcgtctggaaacacggccgttttgattgagaactcgttgagggcggtccggggcggcgtcaggatggccgacgatacggccaaatccctgcaaaatgtggtggagggcgtgaaatacatcgaggagagcatccgggggatcacggaggcttccggcgcccaggccggatccgcggagcaggtgtcccagggaatcgaacagatttccagcgtggttcaggtgaactccgccaccgcggaggagagcgcggcggccagcgaggagctgtccgctcaggcccagctgctcaaagagctgatccggaaattccggctcagagacggtgaggacaaataaccggttgaacgtgtgaggaatgtgtgggaaaggcgttttcgtgccgaaagggggccggaagcgcctttttacgcgctcaggggacggggccaggaaaatgggaggaaacatgcgcttcccggcccggacttcccggcccggatataaaaggaagtggaaaatgagcggaaaacgtggtataaatgagaaagtacatttttttgcccggagggattcatggaaccattttattacagccagatgaataaaacagagagaagcgtttaccacgggatgaagaccggattgacggccctggccccgtccttctgcgtttcacacctggagggacggcagcttgcggacatttttttcaagctgcggctggactgtccggagattttctatgcggtgagtttccagtaccgcgggtaccgggattcggataaggtggaggtaatccccgagtatctgttcgacaagggccgggtgaaggaacacaaacaggccatggaggccagggtcgccaagctggcccggccggctgcgtccatgtccgagtgggacaaggaactctacattcatgatatgatttgcagcaccgtccgctacgacaagctgaaaaagccttattctcacgagatcatcggcccgctgggccagggggtgggcgtgtgcgagggcattgccaagtcggtaaaaatcctctgcgacgccctgggaatctggtgtatcatcgccatctcggaggccaatccggagaaacagatcaaataccgccatgcctggaacgtggtgcggatcggcggcgtttacgttcatctggacgctacctttgacaacagcttaagcaggggcgacatggtccggcacgactattttaacctggacgaccggagcctgtttcgggatcatgagccggcgctctacgggattccgccctgcacggacgggaaccgtttctactaccgggagaaaaaatgttccttcaccaagacggaggaggtggcgaagcgggccgctcaggcggtgaaaaaagggcgggagctgatttttcactggcgcggcggttatctgaccagggaggtgttaaaggagctcttaacgcttatggagcaggcggccgctcagcgcggaaagcacgcggccgtgagcctgaactggccccaggcggtgctgcaggtgagttttcgggacgccgaacccgccaatgagctggtggtcgaggaggccaacgaaggggagcggtgcggatgagggaaacgaagttggaaaaatatggttgaatgaaagtcattgacaaatgttcaactgaggagtattctttaattgttcttttttccgatgcagggaggttaaccgatgcgtatatccaaggagcctgaggtgaggcggcaggagattatagacacggccatgcgcgtgttttcagagcggggctatgaagccacgaccatgaaggacatcgcccgtgagatgaaggtggcgtccggtctgtgttatcactatttccccaataaacaggagctctatgagactgcggtgagacagtacgccagggcatgcaccgcgggatttgtggagattttcagacggacggagctttcacttgacgagagccttgagctgctgggcaatgtgtggaaaacggccaggacggggggagtatttgcctatgagagcttttttcacggcaagggcaatgagatatttcattaccagctggatgtggcggtgattcgggaattgctgccctgggtgacggcctacctggatgcgctgaaggcgcgcggtgagatcggcgtgccggataccggggctgcggcgcgttttgtgctgtacggtcagatcgggatggtggatgaccggagcattccgttggaagcgcggatcgagcggatcaaggaactgattgtgagaacattggcgtgagataccccgccagagcggcgggggaatttttaacagcattattgaattatagtcaatgaataatgttcaattaaggaggcggaatatggaatcgacgaaggagtttcaggaggagaccaggaggtattttgatcgggtggcggaggattacgacgccagctatgacggaaggtttgtgcgatgcatgtaccgggaggtggtcagacgtgcggtttccctgccgggggaccgggtgctggacctgggctgcggcaacggcaatctgatccggatgctgcgggaggtgaagcgggcttcctgctggggagcggacctctccccgcagatgatccgggaggccgggaagaacctgggggacaaggtaaaccttgcggtggcggacgccgccgctctgccgtacggggacggacagtttgacattgtgatctgcaacgcctcctttcaccattacacggagccggaacgggcggtggaggagatacggcgggtgcttaggaccgggggaaccctgatcctgggggatcccaccattccgggcaggctggcccggaagcttttgaaccgggcggtccacaagcgggattccggggattacaaaatctatggaaaaacggaaattacgtctctgttcgcggcgcggggcttccgtgttcacagctggaaacggatcaatttccggtcttttgtgtttgaggcggaaaaagttgaaaattttgattgacattttgattagttagtgctaacctaatcttgcagttaggataccataactttccagctgcgtttgatccacgcagctggaatgaccggattgttcagaaagaggagtgattgtatgccgttgacgatggcgagagaaggcgaggtaacatccatcaaacgggtaggcggaaaggacgaggtgcgccgccacctggagaatatgggatttgtgcccggaaccgacgtgaccgtcgtttccgtcaataacggcaacgtgatcgtgaacgtaaaggaagcgcgcgttgcaatcagcaaggagatggccaacaaaattttgatataaagggtcatggggatgaaaaggaaggagtgcaatcgatatgcagacactgaaggaagtaacgtgcggcagtaccgtttccgtggtgaagcttcacggtgagggcgcggtgaagcgccgaatcatggacatgggaatcactaggggaacccaggtttttgtgcgcaaggtggcgccgtttggcgacccggtggaggtgaccgtcagaggatatgagctttcgctgagaaaagcggacgcagagatgatcgaagtgcagtgagggctgcattttttatgagaatgagttagctaaaactaattttttgatcagatttctcagtcagagaaagaggaggatttgaaaaatgtcaatcaaaattgcattggccggcaacccaaactgcggtaaaaccacattgtttaacggtctgaccggctccaaccagtttgtggggaactggcccggcgtgacggtggagaagaaagaggggcgcttaaaggggaataaagaggtcattataatggatcttccgggcatctattccctgtccccctacacgctggaggaggtagtggcccggaactacctgatcacggagcgcccggatgtgatcttaaacatcgtggacggcaccaacttagagcgcaatctgtatctgtccacacagctgatggagcttggaatcccggtgctcatggctgtgaacatgatggatattgtgaagaagtccggcgatgagatcaacatcgggcagctgagcaaaaagctgggctgtccggtggtggaaatctctgcgttaaagggaacgggcatcatggaagccgcgggccaggcggtggctctggccgcgcagagcagacaaaacgcctccattcataagttcagcgccgatgtggaggctgtgctggaggagatcgagcgctgccttggcggcgggattccggaggagcagaagcggttctacgccatcaaactctttgagcgggacgacaaaattaccgcccggatgaatatggtgccggatgtggagcacctgatcagacgcacggaggaggcgctggacgacgacgcggagagcatcatcaccaatgagcgctatacatacatcgcttccattattgacggctgttatcgcagaaagcacaggcagaagcttagcacctcggataagatcgaccacgtggtgaccaaccgtttcctggcgcttccgatcttcgcgctggtgatgtggctcgtgtactacgtttccgtgtccacggtgggcacctgggccacggactggaccaacgacgggctgttcggggagggctgggaaatgttcggcaggtgggtgcccggcatcccggttgtggtcggtgatttcctggcctccgtgaactgcgccggatggctgtccagcctgatcctggacggcattgtggcgggcgttggcgcggtactgggctttgtgccccagatgctggtgctgttcattttcctggcctttttggaggcctgcggctacatggcaagagtggcatttatcatggaccgcatattccgcaaattcggcctgtccggcaagtccttcatccccatgctgatcggcacgggctgcggcgtccccgggatcatggccagccgtaccattgagaacgaccgggaccgcaagatgacgatcatgaccaccaccttcattccctgcggcgccaagctgcccatcatcgcgctgtttgcgggggcactgttcggcggggcttcctgggttgcgcccagcgcttacttcgtggggatcgccgcgatcatctgctccggtattattttaaagaagacgaaaatgtttgcgggggacccggctccctttgtgatggagctgcccgcctaccatatgccgacggtcatcaatgtgctgcgcagtatgtgggagcggggctggtcctttatcaagaaggccggaaccgtgatcctgctctctaccattttcatctggttcacctccagcttcgggtttgtggacggaagctttgggatggtagaggatctgtccgacgggctgctggcggtgatcggcaggggaatcgcctggattttcgcgcctctgggctggggcagctggcaggcggctgttgcggccatcaccggacttgtggccaaggaaaatgtggtcggcaccttcggaatcctcttcggtttcgcggaagtggccgaggacggacaggaaatctggggaaccatggcccagaccttcactgcggtcagcgcgtactccttcctggtatttaacctgctgtgcgctccctgctttgcggctatcggcgccattaagcgggagatgaacaatgcaaaatggacctggttcgccatcggttaccagacggttctggcctacgcggtgtccctgtgcatataccagcttggcacctggtttaccaccggaacctttggaatcggcgcggttgccgcgctgctggtgatcgcgttgttcatttatctgctgctccggccgtaccgggagggaaagtccctgacggcccgcttaagcacgggaaaagcagtttagacagaattgatccaacgcttttgacaggccggttcccggattttccggtatccggcctgcgacgaaacagaaaaacaaggccctgcaaagccggagataacgcgaggaggaaagcgacatgtggcagaaggaacaggtgattgacgagctgcagaagcgtgggaagcgcgtaacggaacagcggaagatgcttttggatgtgattctggaaggaaactgggtgagctgcaaggatatctactatgaggcccgcaaaaaggcccccgggctggggctggccaccgtttaccggactgtgggggcgttggaggagatcggcgtcctgtcccgggcgtaccagtattcctttttgccggagaataacaggcggtgtggaggggaagggcgggaacgcctgaaataaagaaaattctcaacgaatgccgccggcattgacggccggcttatggaggaaattgtgtaatgtatacaaatatacggtaggcaatttttgtgtagtttcccgcttacacctgctggataaatgtgttatagttaggaacgaaatatggttgtagctctttcgtgaaggccattcacgggagggatacagcctttttcttttttaacagcgggttatccaaccgcccatttaaagaaacagtaggaggaatcaaacatatgaatgaacaagcaaaccgatatctgtcagaggaaccggtgggatcgctgatgctgaagttttccattccctgcatcatgtctcttctggtatcggctctgtacaatattgtggatcagattttcatcggccggggcgtggggtatcttggaaacggggccaccaacgtggtatttccggtaaccattgtcgctctggccatcgcgcttctggtgggggacggttgcgccgctttcctgagcatctgccagggcatgcgggacggggagcgggcgcaccgcagcgtgggaaacgcagtgacggtaatcgtggccgccggtctgattctgaccgtgctgctggcagtatttcaggataaactgctctgggcgtttggagcgacgaagaacaacatcggttatgcccgagagtatttccgctatattgtgatgggaattccattttttatgttcacaaatgccatgaactcagtgattcgggccgacggcagtccggcgttcgccatgttatccaccctgatcggctgtgcgatcaacgtagtgctggacccaatcgcgatttttgtactacactgggggatggctggggccgctttggctacggtggctggtcagctggtgtccgcattgctggcggctggttatctctttcgcaccaaatccttccgcctgaaacggtccagcttccgaccggatggggagctgctgaggcggaccatgcctcttgggatcagcagccttttaacgcaggtttccattgtcgttatcatggtggttatgaacaacgtgttggtgatctatggagcccgttccaggtacggcgcggatatcccgctgaccgtggtgggaatcgtgatgaaggtgttccagatcgtggtatccatcgtggtggggatcgcagccggttcccagcccattgtgggctataattacggcgcgggacgctatgaccgcgtgcgccggatcttcacggtcatgatgacggccgaggcaggtgtgggcctgattgccatgatctgtttcgagtgctttccgttaacgatcattcgtatattcggcagcgagaacgggttgtacaatgagttcgcagtgatttccttccggctgtttctatgtaccatcgccctctgctgcgttcagaaagcctgcagtatttttctccaatccctgggaaaaccgatgctctccatgagcctgtcactgctgcgggattttattctcagcgttccgctggctctgatcctgccccgctatctgggcgtcacgggcgccctatactccggccccattgcggatgttgtctcctttgcggcggcggtattctgcgtgcgccgcgtgttccgggagctgaaaaaggaggaaacgggtgacggaagaaccgccgtctccgaggatcgggttcgctgcatttcttagaggatttccgggaaaaattgatttgacattttggaaatccgcctttaagatggtaaaaaaaggaacacgcgcggcaatccggcagtccggcctgcggattgaagggcagttcaaataaaagggattcaggaggggaatgctgtgattcactatatcaacgatgatcaagagctgaaatccgaatgtttgattgagatggcaaatcaggtatggcccggtgcgtatgacgtcaggcgcatgcaggaggccattgacagaacgatcaacatcaccgcatggcacggcagcaaattggtcggctgcctccgaatcctgagcgatggctatctgtttggcacgataacggagctgcttgtcctgaaggaatatcaaaagcaggggattgggagagagctgatgcagcgcgccatcgatctcactccaacgcccctgtttttcggcgcacagccggaagcggaagggttttatgaaaaactcggaatagagaaatcattgcagtcattttatatcgacaaggaaagaaactaaaattatctgtttctgcgaggcgcgccttcgccaaccggcgggagggcgcgccggttggattcgttttcatttaccgccacaatcagatgcaatatcgcttccaatgcctgaggaacgtaagacttgatctgttcgatttccggaccggacaaaaacagatgtgtcgctctcaccgaattctcccatatctccagcagggattgggttctttcttgtatttcaatgattttcatataatttctgatactttctaccgattgcggtttacagcttctcatctgaccggtttcgcggctgccaacaggaatctgtgggtggacgcttcgatcacgccctctgtgtccagcagattttgggcccggcacagctggctgaaacaggattccacagagaatcccggaaattcccattcgataatcctggcaaaccataccagcgcgcccacatcgtaaaagcggattttggggaacgcttcccgggactgcaaaatttcaaatccagcctccgtaaatgaccggaccgctttttccaggtactgctccgggaatgccagtttcgtgccggggagcagcaaatcgaccagttcgcggtcgttttccgcacccacctgttgcgtcacaaaacagccgccgggttttaaaatgcggtataactcccgggcgtcaaaacggccgtgacggttgataacaagatcaaaggaacagctgtcaaagggcagacaatcggagcggtcggcttcccgaaagtcaattccgagaggaggcaggagcgactgacacaggctgacgttgggcggatagccctctgttgcgctggtgttttccgggggatgattcaggctcaacaaaaattccccgccacctgtatcgatatccagcagcctggactccggcgacagatactgccgcacgattgcttcgtaattccaggggatgtcatgaccttcttcaaagcgcccttcaatatgggagaaatcccatccgtggatgtgggcgatgcgctcctcctgcaaccattttgtttttaaacagtttaaatccatggggacggctcctatttttaatgcaacgttggttgttgaaatcggcgcgaccgtttgaccacataaacggaactgttggtggggagcgtctttaagtgttcttttgatcgagaagtttttggaggcggaggatttcttctttttgcctgaagttttccgtctcctgcctgcgcatctccgtctcctgccgaaggttcttctccctcaacgccttaatctcctcctgctgcaactccaccatcaattccactgtattctgatccagaattctcagcgcctccgaatacatactcaccagctccttcttatgataccggaagtcaaatacctcccggtaaagctctgcaaactcggggtaagcctcgatcacttcgcggatgtcccatggctgatccgaggcgatgaacagcagccatgcatccagttttctacttatattttgatggttttcccgaaaaatgtcaagcgggatcagcaggtattcctgcagcatgtccagctccagaccggtattaaaggtctgcctcgcgtaatgaagatactcctgcgggcaccggtgaaattcagccgtgcttttctgaatcagcacaatggtatagacccgcttgatatcgtgatacgaaaaccgttctccggccctgcgcttctcctcccgcacctgggaatactgccgcatgagcaggtcactggaatagcaggcgcagcgggcgccgggaaacaggtagcccacccgctggatctccacgttcaccaacgccccggacgccagtcttaccagaatatccatcaccagcagagacccgccctcggtcagccgcccggattcattgggaatcacctggagaatcttcaccttctccccaagacagagactgatgaactcctccagccgctccggcttcgttccagggtcaaagacaaacttaaacatgggatcataggtgatccgcatcccattcacccccatacagaaatgcaaaaactcctcctttaacccctgtgacagcctttgatactccgccaaaagcgtctcgtccgtttccagctccgccaacacctcctcccttgcgctgcagggtccgaacacctccgggtggcgctccatccagcggaccgcctccatctgcgccccgcaaaaaactgtttcctgattgtgattgaattccatagacattcctccagatgtgaaatgagataaacgtgaatcccggccgatttggccatagaccgttgcagaagaactctgcaatcgaatgtaacaagagatacatttccttaatcctaccacaaagagagcgtctgtggaagcccttatttcgcattctgtcatgtcatattcccacaagtatacccgcggatttgacttttccgcagccagcaattaaactataagaaacgccccggtttgcatctcgccacgcttctaagaaaggcaccacgatgtcactgaaaatcaaacgatatgtggtaacggtaatttgggggctcttcctcctgatccaggcgtcctgtcaggcggaaaacgttcacgaagcgatcacaatgctcagcttcgtcccaatcctgtttacggtctggttcgggggcgcaggcgttttcctgaccacctcctgccttgccgctcttttagacaccgcctttgtgatggtacagcgctataaccgccacaggctgctgcgcctgatccaaaaacaatcgaaacgaggaacaatatgaactcagattttgtaaaactgacaaccgacaacctggcggatgagcatttatgctgtatcatccgcagcaaaaagccccacccgggcgtggaggcgaagcggcaatggctttccgaacgcttggaggaagggcacgttttccgcaaattaaatgaaaaagccgtggtattcatcgaatacgcccctcttgaaaccgcctgggttcccgttctcggcgacaactattactatctgtactgcctgtgggtcaccggcgaacacaaggggaagggctatgggaaggctctgatggactactgtctggccgacgccaaagaaaagggaaagtccggcatctgcatgctgggggcgaacaaacagaaatcctggctttccgaccagtcctttgccaagaaatacggtttcgaggttgtggataccactgattacgggtacgatctgcttgcgctttctctggatggcacaaagccccgatttgctccaaatgcgaaacaggggaaaatcgagtctcaggagttgaccatctattacaaccttcaatgcccctatatctgccagtatctggaaagaatcagacggtactgtgaaatgaacgccgtcccggtatccttcatccatgtggattccctgcaaaaagcaaaggggctgccctgcgtgttcaacaactgggctatattctacaaagggaatttccagacggtaaatctgccggacgaagcgaccctaaagcggattctgaaaaaataatcataacatccaatcaaaacagccccttttgcaaattcgtggtcaatccactctgcaaaaagggctgtgtgtttttatcaatccaattccggcagcgccacaacgttcaccggcgtgggaatatccactgccccggccagctccagccctccgtcctccagcgcgatccggaaaatggacacgttgtccgagtcctggttggcgcagagcagataagcgccggacggatcaatacagaagcttctgggcgtccgcccgttggccgggaaatcgcccctgtggcttaaggttccgtctggggctacggcgaatgcggagaggcagtcccgcccgcggttggagcagtagaggaatctgccgtccggcgtgaggtggatatccgcgcagagattgtctgcattacggccttgggacggggatttgtcgtaggaatccacagtctgaaacggcgtccagccggagccctcccgccgcagggccagaatcccggaggaaagctcaagggacacgtaacaaatgtcaagtccggcggaaaacgccggatgtctgggaccgctccccgcgggagcggcaatttcccgcgcctggttcgtgagcagccgggaggtttcggtggaaatgggatattcacagattcggtccgtgcctaaatcgcagaccatgatccggcccataccaggcacggagacggcgcagtggacgtgaggggcctcctggcgtcccacatccgggccggacccggaccggataatcagctggcgtatgggttccagggaaccgtccccgttcaccggaaacgccgacaaagagccggaggaatagttggccgcaaacagcaggccggactccggggccacggacacgtagcaggggtcctcccccatggtgggcacggtattgatccgctccagagccagggaatcccggtcgatgcggaaggaggagacggctcccgacgccatcccctcgtactccttcagctcgctgaccgcccagagaaatccttggcccgaacagcagagaaaggatgggttgggcacagaagggtttacgtggaccacccgggccgcacccgtatcgtgatccagggcgatgcagtaaatgcccccgccctttcctaaaagcacctccccggtgccgaagtggatgggctgtgtgtaggttcccacataaaaaaatgtctccatgtcagctctcctttttgccgtttttggcggactccctgcgtttccgctcccggtcccgcttttgcaggtaggactggaaccgctttttgttgccgtccgtgaaggtagtcatgagctcgttcagatccaggtcgttctggtgggtcagatagtggtacagcttggagtgggagtccgaggagcttagggagctctgcagcagcgcctcggattccttcgtgttctcgaacataaatttgttcaattcctggaaatatttgtaatacatatttttaaaaatgttgatgatctggatgaaaatgtcgtttcccgaggccaggataatggaaagatggaacatgtaatcctgcttggtgtactcctcgtaattgcgctccgcaagagcccgcttcatgccgaaataggcggagccgatggactctaagtccacgcgctcctgctgcatgatcaggcggatggactgaatctcgatggcctcccgcagcgcgttgatctcgttgaattccttttccgtcagatccaactcccgctcaaaattggacatatcgtaaatctcttccggcttcaccacataggtgcctttgccgtgcttcacctccaccaggccgatggcctgaagccgctggatggcggcccggaccgtgacccggctcacccccatcttctgaccgaggtccgtctccgagggcagtttctcgccgcttttccaggtcccgttctttatatccgccagaagggcgtcgtaaacagccgcgtccattctctgttttgtgatggtactgattgccatgttctctcgcctccgatagatgtattacaacatacatcgtttgctaccactataaaccggaaccgttaaaatgtcaatatttctaggaaaattcaccaaaaataaattttaaaaaaacatattgacaggcaaaaataatgatgatatattgaattcaccatcaagttgtattacgacatacaactgagcggaacaactatctgacagaccggaaagggggatttttatttatgaaaaaaatgttcaggacactggcagcgttgacgctggccgcatcgctggttggctgcggcgggggaagcggaggcggtcaggcggccgctggaagcagcgccgcccagggacaggagaacgcccgggagagcgcgggagatcaggcggacactcaggagagcgccgcggatcaggcagatgccgcggatcagcccaacgccgcggaccaggccggtgaggtcacgctgaccatcgcctccgccatggtgacggagaagccggagggggatctggagcaggagctggcggacaagtacatggagcttcaccccaatgtgaagatcgagtttatttccatgcccgccgctgaggtttccaagcgaatcgtgaccatggccacgggggacaacctgccggatatgttctttgtgcccaacgattttatgcctcagctctacgatctggagattgtggcggacctggaggggctgctgggggaagagtggctgtccggctacaatcccaacctgctcaaggacgcgaagattaacgggaagatgatgagcattccctggtatgcatccccctatgcggtcatctaccgcacggactggttcgaggaactgggacttgagattccggagacctgggacgagtttttggaggtgagcaaagcgctgacccgggataccgacggcgacggccaggcggatcaatgggccttcagcatggtgggaagcaggaacaactccggcgagcagaggttcgtgctgttcagcaagtccttcggcgcggacgagatctatgaaaaagagggaaaatgggccacggacatcggaacggagcagtttaaggcgggcctgaagtattttacggacctgtacaccgagcacggtgtggtgcctccgggccccacggaggttgactactccgcgtccatggagctgttcacttcggagcagaccggaatgatcctgtccgggcctcactccctgggctttatcaccaccaccaaccccggtcttgagggaaaactgggaagcttcgtgatccccaggggcgaggcccatgtctccatctccggcatcggcggctacgccatatccgagagctgcgagaacaaggacgttgcggcggattacatgaagtttatcacgagcaaggagaacgccatctacttcggacagaagacggggcggatgcccaccagaaccgaggcaagcgacgatccctatttcagctccgtgctgtttaagggattcctggaagccctggactacgcggtggatcccgagacatttgcacagtatccggcgctgctggacaccatcggggaggcgtactccaacgtgctgtccggcgtggccacattcgacgaggcttacgggacgctggtggagaagtccgcggccctcattgatgctgaaaactgacggaagaaaatcgggtgattgtcatggagaaagaaacatcaaaagcccgcctctcgccaggaagcgccgggagcatatcccggcgggagatcaacggatatctctttgtactgccggtggccgccgttttggcggccctggtggtctaccccctggcctacggcgtttatatcagctttttcaagaccaatctggtgaagaaatggaccttcgtgggactgcgctactatctggaagccctgaaaagcccggaatttcttgggcagatgctggtgaccgtgaagttcaccgcaggcgtggtggcgggacattttttcttcggaatgctgctggccctgctgctgaaccggaattttagagggcgggcggtgttccgcgtcatctttctgctcccatggctgttcccggacagcgtggtggccctgctgttcaagtggattctgaatccggtttacgggatcttcaaccacgtgctcatgcagctggggctcatcgacgctcccctggtgtggctgagcaacgccggtctggccctgcccattgtggtggccatctgcatctggaagggctaccccatgatcatgatgatgctccttgccggcctgcaatccatctccgacgacgtgaaggaggccgcccgcatcgacggcgccaacctgtggcagtccttttgctacgtgacgctgccggggcttagatccgtgctgacggtgaccctggtgctggatacggtctggtggttcaagcactataccctggtctgggtgctgacccagggggggccggggaacaccacctccctgatcagcatttccatctataaacaggcgttcgacaactttaatttcggatcggccgctgcgatgtccgtcatcgtgttcctgatttgctatttactgggaattatttacagaaaggtgctggagaatgactgaacgcatgggaatgagaagaaaaaagatcatggccggggtggccatgtacgtgctgcttgcgctgctggcctccctggtgctgatcccggtgctgtggatggtgtccacggcgttcaagtcctacggggagaccatcgccaagccgcccaggtggattccgcagcagatttcctttgaggccttcggccggctgtggagcgaatatcccttcgggacgtattttaaaaacagctttgttatcgtgctgttttccatggcggtgtccgtgttcgcctcctgcctggccggatacggcctgacgcggttccgattccggggcaggaacagcctgatgacatttattctggtgacgcagatgtttccctccgttatgctgctggttcccttttacagcatcatcgggaaaatgcatctgctggacacccatttggggctgattctggtctacatctcctttacggtcccgttctgcacctggactatgctgggctttttcagggcgctgcccctggatttggacgaagcggccagaatcgacggctgcaattcctggcagtgctttggccggattattctcccgctgaccctgcccggcatcgcctccaccagtatttacgcgttcatcacctcctggaacgagtatatgttcgcgtttatcctgaccagcaggccggagatgaagaccctttccgtggggattgcggagatgaacggattccagcaggtccgctggaacgatatgatggcggcctccctgatggccagcctgccgttaatcctgctgttcgtctgcctgcagaaatactttgtcagcggtctgacaagcggggcggtaaaatcataatgtgacgacgaggagagagaaaatgactgtgacaattcgaactataagcgtgacctgcaccaggcccgggggcttcaacctgaccattgtgcgggtaaatacctcggagccggggctttacgggctgggctgcggcactttcacctaccgccacgagacggtggcccacgtgattgaagaatatctgagcccgctgctcatcggacgggacgtgtcgcgcatcgaggatatctggcagatgatgaacgtggccacctactggcgcaacgggccggtgattaacaacgccatggcagccattgacctggccctgtgggacatcaagggcaagatggcggggatgccggtctacgatctgatgggaggacggtccagggaggcggtgccggtttactgttacgccgagagcggcgatctggacgagctggtggaccaggtgaagggctggatggcccgggacgtgcgccacgtgcgtatccagttgagccgcgatcccgcccaggccgcaagccatgcgccccaaggggcccaggacgggtattacatcgatccccaggaatactgccgccgggtggtgcggatgttcgactatgtccggacccgggtgggggaccaggtggagctgtgccacgacgtccacgagcgggtggcgccgtccacggccctgtggctggcaaagcgggtggagccgtactccccgctatttttggaggaccttctgccgccggatcagggaatatggtaccggcacatccgctgccaaacctccactccactggcccacggggagctgtttaacaatcccatggagtgggaggaactggtcaaggagcgcctgatcgactacatgcgggcccacgtctcccacatcggcggcctgaccccggccagaaagctggcggccctctgcgagcagttcggcgtccgcatggcctggcacggctcaccggacatgtcgcccatcgggtacgcggtcaacctgcacctggatatggcggtggccaacttcggcattcaggagtggcccggaatcccggagcccatggaggaaatgttcccgggctgcccgtatatcaagggcggttacgcctacgtgagcggtaagccgggatggggcgtggagttcgacgagaagctggcggcggaatacccctgcaataaggagaaaacgccctggattgagatgcggctgccggatgggagtatgcagaagccgtaaaaaagtgaaaaggcggacagaaccgcagaacatcaaaacgccgcgggaatactggtttccagtatcccgcggcgttttgcgatgtccgaaacggctcgttcgcgcgttcccttaaaactccataaaccccgccaacatcccgataaactcctggtaatcccccgccgtcaccagccgctttacattctcccggctgctgagcaccatggtcagcggttcaaaaatctcattgaagataaaacgctcgtcccggttgaagcagagcatcagcacgatgcgcacctgcttatccccccatttgaccggcgtgtcggagatcagcacgttgattccggttctgtgggcgcgcatcttcatggcgtgggggatggcgaaatcctgaaacgcggtggcggacagctgttccctggcgcggatatcctgctcaaaatcctcgtccacgtaccccatggagaccatttttcccaccatatgccggacggcctggtcgtaatccgtcagatcgtcccgccgctcgaagaattccggcacgatcaggtactccaggtattcccggaactgcttgcggcgcttgttggtcttgatttccgtcagctgcctgcgcagggactgcacatccttttccgtgaaaaaggggctgatttgcaacagcggaagctggatcacggagttcaacggcaccgtggacagcaccaggtcatttttaccggttttttccagctctcgttcttctgtgaaaatattggtgatcagaagctcagaggagaaatgccggttgatggtgtcggtcagcttgacattggtgtcatagtagctggggcagtagagggccgccgtgaccttctcgcttaagtttttctgggcctccagcgtgctcccaaggtggaaggcaatgtaagcgatctcgtcgtcgttgattgagattccggtgcgctccttgatggtgctggataagcagacggaaacgtcgtaaatcagcgggcaggaggttttgatctcttcggtcagtgggttccggctgaaataattgttcttggagcgctggagcaggttgcggatatggagagcaaagcggatcagaaactctggttccgtcaggtcgatgtagtaaaaggaattgacgtcggagatcagctctttaaccagggcgaggcattccggggtgataaaatcctccagattggagaccgtgatgctctggtagtcgatggccgtggcacgggagatgaggagcagggccagctcgtagacctcggcctggttgtattcgatccggaaatcctcctcgatcttgcgcgcgatgttcctcgccagctcatactcgtgggagctgatgggaggcatgtcccggatatcctcggtgttgacgttgcggttgcggatccggtcgatggcgatggtgatgtgcagcaccaggttgatcagggaataatcgttcacaaaataatgaaaccggtcgaaaatctccagcagactgtccttgatcagttcgatctcgatctccgggaaaatattctggatggtctccaggttgacgaagttcacgttggactcgtcgtagagaatggagctgagcagcctgcgcttgtttttttccagaccggatacggtcagattgtcatggttgttgttcagctggagatcatacttgcgcagcttgctctttaccgcctgaaggtcgtttttgatggtggaatagctgataaacatctcgtcgcagagatcgtaggtgttgacggaggtatcgctcttgatcagactgttgatgatgtacacgatgcgctcctgggacgactgggggatgtgggtgcccgattcctccagaatccgtctggcggcctgcttgtcgatgcggtagccctcccgggaggactcgatggcctcgggataaacggaattgatctcctgaatatagctcttgatgctccgggtggacacatccatattggcggccaggctggaagccgtgacaaactccgtataatcggacagaatccgaatcaacttaattattttaggcttcatatccatcctccttccgtttaaacaatctatctaatattcgtatctgttcagtaccttcgcagatacgagcaaaaatccatttaaaatcgacttggtcgatgggatttttgcctgcaagcccatgttttcatacggtcagcgcagcaagtgcgcagacctactgaacagttactaatattcctattatagtatcccccaaaatggttttcaactaaaaaattgcacaacctatgtgcaaacaattacttgcacggccggggtgcaaaagtaaagttgcaccatggaaatgaattttgtatgatgattgcagataaaacaaacaaagacgtcctgcagaggcgggagatgaaaggagacatcatttatgaagaaattaaacgttctgttagtatgcggttccggtgcaagctcaggatttatggccaccaacatgaggagagcggctgtggccagaggggtggacatggacatcaaggccagaagcgagagcgagatcgagaactatgtggacgagatcgacgcgctgatggtgggcccgcacctggcctacattctggacgaggtagaggagtacatcggggacaacgatgtgaaggtgattctgatgaagccggagtattactccacgttggacggcaacaaggcgctggaccatctcattgcggaaatggaataaacgtttacaaacgggataagggggagttttaagaatgaagaaattaattagctggctggagaatgattttgctccgaaaatgaacgtggtgaaccgcaacgtgtgggtggtcacgctgaaggattccattatgcaggtgcttccgtttatcctgctgggctccatcttctgctgcctgaccattccgggcgacgtgttcggctgggcctggtggcccaacttctggacgcccttcgggtggaccatgggaatgctttccctgtttgtggcgtttttgattccctttaacctgatggaaaagaaacgtctgcggaaacagcggattatcgccggactcaccggtattgttacatttttaatgatcatcacgcctcaggtggtagcggacggcgccatcggcttctcccacgattctctgggagcgggcggtatgttcatcgccattatcgcaggtattttttccggttacgttgtaggattgttcggcaagttctccttctttaaagaggactccgtgatcccggatttcgtgcgggcctggttcgactccctgcttcccatcggcattgtgatcatcgtggtgtgggtgctggtggatatcctgggactggacatttacaacatcatccagggaatcttcatgccggtagcggccattatccagacgcccttcgggtttgtgctttcttccttcctggcctgctttttgtactcaatgggtatttccagctgggtgcttacgccggtgacaaaacccgcgttcatgatcggcatcacggccaacatcgccatggttgcggctggaaccgcgacgcccgaaaccctgaacctggtaacggacccaaccgtttactccgcttacatgtggatcggcggtattgggtgcaccttcccgttggttatcatgctggccatctccaagagcgccaaattaaaagccctgggccgcgcctgcctggtgcccgccgtatttaatatcaatgagccggttgtattcggctgcgtggcctggaacccgatcatgatgattcccatgtggctcaccagcatcgtgctgccgctggtaatctgggtattcacgaaggtgattccctttgcgcccattcccaccatcgtgttcgacatgtggtactgtccgttcccgatcagcacctggctgaccacacagagcatcaagggaattctgctcatgattctctgcgcggtgatcggaaccgtgatctggtatccgttcttcaagacctatgagaagcaggaaatcgagaacgagcaggcgaagggttgacgacatattcaatttgatcaggaggtacaagaatggaaaaccagatgattgacgagaaaacactgactgcggccatgtccattatcatcagcgccggggatgcccggctgctgtgcagggacgccttaaacgccattgcggagcagaattttgcgctggcaaacgagaaaatgaaagaggccaacaagaagatcaccgaggcacaccgggtgcagacggatgcgatccagggggagacccggggcgagaaacaggagtacacgctgctctttgcccatgcacaggacacgctgatgaccatttacagcgagatcaacattgccaagcagatgttgaagatttttgagagctgggagaagcgctttgaggcgctggaaaaccgctaaatttataaaaatacgagaatgtaaaaaggggagttttcatatgaggaaattatataaaatgctgttggcatgtgcggtggcggggacactgaccgcatgcgggacacagacgggtgcgccccagggggccgccgatcccaccgaagctgccggggagacaggcggcgcggaggccgaaaagacctccgagggggacggcgctatcaccctctatctagtgcgccatggaaagacattcctaaacaccacggaccaggtgcagggctggatcgacagcccgctgacggaaaaaggggagagccaggcggacgccgtggggcgtgggatgaaggatatcaggtttgtttccgctttcagcagcgacttaggacgccagcgggagaccgccttgcgcatcctggcccagaacgcgggaccggcgccggagcttcgggaggtcatcgggctgcgggagtggttttacggcggctacgagggcaaaatgaacgcggagatgtgggatcccatctttgaggcccacgggctgaaattcgacgccgagtggtcccagtacggggagctgcttaagcagatgaccgacgaggacatcgccaacgccatcgcggccaacgacgcgttaaaacaggcggagacctacgaccagatcaccaagcggaccatcgaggccatggatgagattataaaggtcacccaggaggcgggcggcggcaacgcgctggtggtgtccagcggaagcgagatccccactattttagagctggtggtacccgggcagtacaagggcgaggatatcagcaactgcagcgtgtccgttctgacctacaaggacggtgtctacactctggaaacctgcggcgacaccagttatctggaagccggaaagacagaggaagagaagaaacaggaagccgaggccgcaaaaacggctgcggccgagccggaggaggcagggaacgaggccctcgccacaggcgagattctgatcccatccgcaaggggcacagagatccacgccactttcacggtgcctgagaccatcggcgaaaacggctgcccgctggtgctgtttgcccacggcttcatgggcagcagggacgagagcggcgagtttacggccgtggccgacggtctggcagagcggggcatcgcttccatgcgaatcgatttccccggctgcaatgagagcacggagagctttctggaatacaactttaagaacatgagcgacgatctggacgcggccctggcttacgcccgggaggcggtcaaggtggacgagagccgtctgggaatcctgggatacagcatgggcggacgtttggcttcgctttatctggacaaagaggcgttccacaccgcagtgctgtgggctcccgcggcttccaacggattcgacgccgcttccgccatgggcacggccgcggaaatggaggagcagctgaaaaagtctcagaccgagggcaagggcgtgatccacatctgggacgaggacattgaggtgggagcggagtaccttcaggaattaaaggagggtaagcccttggagcagctggccgcctacaccggaaatctgctggtggtgaccggcggaatcgacgacacggtggtaaaatccatcacggatcaggtattggaaactgcagtgaacaccagcatcaccgctaatctcaacattccccgcgccggtcacggcctgggcgggtacgagggcgaccaggaggtcgtaaaagtggtggtcgacgcgacggtgaatttctttgacgacaatctgaattgaaaataggaggcatggcatatgagcagagtaccggcgggatttcccgagaactttatgtggggcggcgcagttgcggccaaccagcttgagggcgcgtgggacgaggatggaaaggggctgtgcatcgcggacatcaacgagttccgcgacgacatcgccattgagaaaaaaggcaatgaggagttgaaccgcgcctacataaaagaggctgtggacagcaaggaaaaggtgttccccaagcgccacggaatcgatttctaccacacttacaaagaagatttgaagctgctggcgggcctgggccttaagaccttccgcacctccatcaactggtccagaatcttcccaaacggcgacgacaaagagcccaacgaggccgggcttaaattctacgacgacctctttgacgagattctgaaaaacgggatggagcccatgatcacggtgtcccactacgagatgcccctgaacctgaccctgagctacaagggctggtattccagagaggtcattgacttttttgtgaaatactgcaatactgtatttgaccgctacgcaggaaaggtgaaatactggattctggtgaatcagatcaacctgatcggccatgagtccttcaaccacctgggcgtggccgaggacgtggtggaggacctgcggtccgccaaataccaggccgtgcacaatgagatggtggcctgcgccagagccaccaaatacgcccacgagcaccacccggagatgcagatcggcatgatgctttgcggcgggccggactaccccgccagctgcaagcccgaggatatgctggcgaccttaaagcacaaccagatggaatactttttcgccgacgtgcttctgcgtggaaaatatccgggctatgccttccgcttctttgaggatcagggcatccacgtggagttcggggagcaggacgaggaggacttcaaaaataccgccgatttcttctccttctcctactattacacccaggtctgctcccaggagagctatgagaagggcaacgatgtgtaccgcaacaaggagctgcccgccaatccctggggctggaccatcgatcccgtggggttccggattctgctcaacgaattctatgaccgctaccagaagccgatttatgtcacggagaacggcgtgggctattacgacaagctggaggacggccaggtccacgacgattaccgcgtggactactaccgggagcacatcaggcagatgaaggaggccatccgggacggcgtggacgtgagaggctactacgcctggggtcccatcgacatcatttcctgctcctccagcgagatgagcaagcgctacggctttatctacgtggacctggacgactacggaaaaggcaccggcaagcgcattaagaaagacagctatgcctggatgcagaaggtgatcgcgtccaatggagaggatttgagctaggcggtaaaacggaaaaggaggcatttcgtgaaacgctttcaatatacggtaaaatcgctgatcgggcttcatgccaggcccgccggcctgctgatccagaccgcccgcgcctaccggtcggaaatcaccatccaaaagggcgaaaaaaccgccaaccccaagagcctgatgtccgtccttgccctgaacgtgaaccagaacgacgtgatcgtcgtgacggcacagggggaggacgaggaggaagccattgcggggatggaagggtttgtgagggagaatttgtaggggagaggcataagctgcgagttgttataaaagcgaaaaaaggacatttgccctgtgctctgccgaggcggcggagcgtgaggcgatgtccttttttgattggccggacgggagaagggccgtcccaatagtccgtactgcgtatgaggggttttaggaatcctgtcccatccgtacgccgcttacataaacctgttcgatgttgatatccgaatcaaacacaagcaaatcagcattttttccaacagaaagactgccggtccagtcgaatatatggcagagcttcgccggattttgcgtcatgaatttgacagcgtcccatagaggcatatgtaattgttttaccaaaacgcggatcatccggtcggcggttgcggtgctgcccgcaaaacaggagcggtccggcatctttgccacaccgttctcggccacgcattgaaaattatacttcaggcttccgagtaccgttgggccttctggcataccggcagcccgcatgctgtcggtcaccagggtgatatggtcgtggtccttgagcttgaaaatcagttccagaagctccggaggtaaatggatcccgtcgcatatgatctcaatatgcatgtcgtccagcagatatccgctctcaaccaccccaagaatccggtaaccgtttttacggtgaatcgtggacattccggaataaaaatgagtcagatggtgatagcctgcgtcaaaggcttttcttaccacatcataatccgcgtcggagtgcgcgatggagggcaggatgccaagctttatcagagtatcccccaattcgatcacgccgggaacttccggagccgaggaccaccgccggatattcccgccgctgcggccgatgatcttgtcaaaatgatgaggaaatgggaccgtcatgcattcagccggctgcgcgccggcttgttccggggaaaaatatggcccttccagatgaagccccagcagatgaggcatattttcacgtatcggtttcgcctgttcaaaacagtcgaacagctgaaataattcgtcgtcaaagcaggacatggaggtcggcatgatggaagttgttccgtgcgttaagtgcatgcggcaggcggttaaaaacgcctccaacgtaccgtccataaagtcagcaccgcctgcgccgtgggtatgggtatcgataaaaccaggagacaaaatgtgatgattcagatcaaccctgcggtagccgtcgtccagggcgggcggagtccccttgccgatgcgctcaatgataccgtccgaaacggtgagatacccgtcgttgatttctccgtgctccgacaagattataccattataaaacaagagtttggtcataatgcctcctttttgtgacaaaaaattgccatattagtgaaaaatgcattgacagaaaacattttagttgatactattataccatgataatcgtttttgtaaaacgttttctataaaattatgaataaataggtgttaaaaatggagagtatgaaagacaacagtgaaaaaaagttagtgaccataaaggacatagcagagaaaagcggatattccatcgccacagtgcacagggcgttgaaccacaagggaggtctcagcgaggaaacccggatgaagattctcaacgtggcaaacgatctgaactatacgaataattatattgcctctgcgctgtcgagaaagagcatcgatatcgccattgtgctgcccaatccccagggattcggcaaatactacttcagctatatgattaaaggaatccgaaactgttatgaggagctctacagctacaacatcaatttgctggaatgttattacgacaaggaggaatctgaggaagaaggccaaatcaaaaggcttcaacagctgtactttgaaaaagatcatgtgctgcagggccttatcatcgctcccatatccaacagcgaggtgctggtgaaaaccttacaggcatttgcccgggaagggacaaaaatcgtgtttatcgacgacgacctgccggaagtcaaccggatctgctgcgtagcgcccagcgatgaatacattggaaatcttggagcggagctcatgtcccacatgttaaaaaaacaggatgggaaaatcctgctggcagcaggaaatcccgcccagtctgcccatacattaaacgcaaagggtttcatcagctatatgaagcagtatcgccctgatattgaggtgattgtcgcggaagacggcagagatgcgcaggccagctatcaaaatcttaaaaaattgcttcatgaaacggacgatatcattgccgcatattcagtccgtgcgaaaaacagtatcccgctttgcagggcgatccaggatacggggaggatcgatgacatctcaatcatcggaagcgacctgtttttggaaacggaggaactgctggagagcggcgttttgtcagccgtcatctataaaaacccatatcagaaaggataccgggcctttcaaatcctgttcgatgccgtaattaagaatataagtcccaaagaagaactcatatacgttccgatcagtattatattgcgtagcaatttacgcttttataaggagtttatttaacgttaaatttcaaaggaggaaaatttatgaagaagcaaatcgcattggcaacagcggcggctatggtattggggttagcggcctgcggctcgaaaccggctgagacaaagcctgctgagaccgcggcgcaggcgaagacggaggcagttacagaggcggaagagaaagaaacggagccgaaggagacggagggctctgcggcggcgatcacctttaaactggcggataatcaggcggatgggacgcccaatgtttcgggggatacaaaatttgcagaactggtaaacgaatataccgggggaaccgtggtcgtggagatattccccaatggtacgctgggagacgaggcatccgtagcggatatgctggaagcggacacgctggatattgcccgtatcagtaccaatggcatttcccccagctgtgacgcgttcaatgtgttcggcatgccctatgtgttcccgtccgatgagatcaaatataaggcgcttgacggcgaattcggccagacgctgaccgctaaactggaggaggaaaccggtttgatcaatctggcctatttcgtgtcaggtcccagatccttctataccaccaaaaaggaaattcactccgtggcggatatggccggcttaaaactgcgcgcgcaggacgatgcgatcaccatcgcaatgatggaagccctcggcgcttccgccactccgatgaactatgcggaggtatattccgcacttgaaacgggcgtggtggatggagcggagaatgactttacctcctattactcatccggacactatgaggttgccaagtattactcgctggatatgcatacggcgccgtcctctcttctggtaatgagcgcgggtgcatggaattccttatctgccgagcagcaggagcaggtccgcaaggcagcggcggaagccgagacatatcagagaaccctggtagaggactatattgcggaatccagacagaaggtggaagagggaggagcaaccattattgaggtggatgtagctgaattccagaacgcatgccagcctgtatacgataaattcccacagtataatgatcttattgctttaatacctgcagaataatagagttgccgggattcgaacggttgaatcaaatgatggggattgcgttggggaagggtatatgcgcaatcccctatctgttaccgaacaattagaaaaatggagggggaatctgtgtgaacaggggaattgaacgcgcggaacatttgtttcggagaatcatcaaactggaagaagccatctgtgtggtattacaaattataatgttggtgatctgttttgcagctgtggtaaaacgctatttttttaatgcgccttgggcatggacggacgaaattcagctgctactgctggtaatctacggatatcttgcaatttccatcgacgtatacagggataaccacgttgcgttgaccgggatgtataaacatttgtcaaaaagaggaaaggttgtacttgatctgatcagacacgttctcctggggggctttttttgcctgatgacgtattatggctggaaagtttatggaattaaggccaggaaattattgaccgtgacccatctctctcagggaattgtttttatggcacagacgatatgcgcggcgctgatggtgttgtattgcctgatgaattttgtaaaagcagtcaagggctttcgcgaagcgtctgccaatgaagtgtgagagaaaggagcataagtatgaccgaatcatccattgcgattataattttgttcggaacattgatcgttctgatgtttatcaggataccgatcgctttttcactggggatttccgctgttgtaacggcgctgtatatggatatccctctgatgaacctctttatgaaaatggtgacgagccttcagaatttcgtgattgtggcctgtccgttctttgtgatcatggcccaggtcatgggagacggaggaatcacaaaacggctgatgaaattctgcaatttgattgtgggcagaattcatggcggaaccgcactggtcaatatcctcgtgtccatgctgtttggcggaatttcaggttcctccacggcggatgtgtcgtccatcggctcaatgctgattccggctatggtggatgaaggttatgacgccgattattctgttgcggtaaccgttacctcttctctggaaggggttatgataccgccctcgcagaacatgctgtattatgcggtggcctctgccagcggtatctccatcagcacactgttaatctgcggcttcaccccgggcgtactgctgaccttggggttggcgatcccggcttatatcgtggcaaggaagcgcaactatccgttgagcgagaaattcccaaggggagagcggctcaaggtgacgctggatgcgatgctgggtctgggcgcgattattatcgtggtcgtgggtattacctttggaatctgttccgcaacggagtcggcatctttggccgcagtatatgcaatcgccattacgcttttgttctaccgctctttgaattttaaacaaatgataaaagccatcaaggcggtgactcccatcatgtccatgtcgctggccattattgccgcatcgaacgcattcagttatgtgatgacctccctcagagtgcccacccttctggcggaattcctgctgaagctgtccggcaacaacaatgtcatcatgctcttgatgcttgtgctgatgctgattctgggctgttttatggatatgggagttttgattctgttatcaactccgattttataccccattgcggtgaattcacttggatggaatccctatcagtttggcgtgattcttgtatttgcatttgccattgggttgtgtacgccgccggtgggaacctctctttttattggatgtaagatcgccaatattccggtggaaagcagtatcaaagcgtttcttccattttacattataatgatgatattattgatactatttacttatattccggctttgtccttggggcttccgatggcgctgggattattgtaaggaaaagggggacttatggaatatcgtgagttgaaaaaatgggctgggttttatgagaatgaattgacgaaccgttttctctccttttggattccaagatgtgtggacgcaaaaaacggcggattcgttaactgctttacgaatgacgggagccggcttgtaagtaaggacaagtatgtgtggagccaggggagatttgtctgggtattctcaaaactggcggcaaccagcgcgccgattttttcacggaaacagagggaagaatttctcagcctggcaaaacatggggtggattttctgatgaaacactgcctgatcgctccggacgattggcgctgtattttcctgctggacgaaatgggaaatccgaaatatgtggaagggtgtgaccggctggatatgagcgtgtacgcggattgctttgttgtgggtggtttagccatgtacgcggcgcagacagagtcgcctgaggtatatgaatttgcaaaaaagctgtacgattccattctcgaccgcgtaaaacgaaacgattaccagactttgccgtatccattgtcaaagaaattaagagcgcatggtattcccatgattctctcaaatattacaaaagatatctaccaggcatctttgaaatatgatccggattaccgtaatacggcgcttaaaaatatggagggctttaccggtgataccctgtcgcattttgtagatccggatggatgcctgcatgaagtaattactgctgagaatcaattttttgatcaggtactgggaaatcatattaatcccgggcatactctggaggatgcgtggtttatgctggatactgcggagcttacaggtcatgcggaatggaacgaaacgatctataaattggcgctgaaggcattgtgcacgggatgggatgaggagtacggcgggcttcttcactttgcctctttgtccggaggctgtcctgagggagataacagtggatatgaggatgagccgatgtcaaagcagctggccggctggggggataagctttggtgggtgcattcagaggcgctgtataccacactgcggtgttacggcgatactgccagcgaaacatttttaagctggcacaaccgcttatttgactacatctacaagctctatccgaatacggatccggagattggcgagtgggttcagatacgggagcgggatgggaaaccggctgagaaggtggtggctcttccagtcaaggatccatatcacatcatgaggaatctgattttgatcatagagtgcatctataagataatggacaggcaagggggaaaatagcggattatgataaaggaactgtgcattgataagctgaaggtaaagatatttgaatcgcgccgggaaatgggggaatgcgccggaaatgaaatcgccgcctgtatgatggaattattaaaagagaaggaattgattcatgtcatgttcgcggctgccccctctcagaatgaaaccctggagaccctgtgcaggtatccgattccgtggaaccgcgttaacgcgtttcatatggatgaatatgcagggctggatgaaagtcaccctgcagggtttcggaattttctgaagcgagcgatatttgatcgatacaattttcattccatcaatctgatcgacggaaatgcggctgatttggaggctgctatgaggcggtatgatgaattgctggaagcacatccgctggacatctgtattctcggaattggagaaaacggccacatcgcatttaatgatcccgatgttgcggattttaacgatcccgtccgggtaaaaaaagtgaagctggatgaaaaatgccggatgcagcaggtacatgacggctgctttcgcgatatttcagaggttcccacccatgcggtgacggtgactgtccctgcattgtgtgcggcgggcaggatgttctgttccgttccggcagccacgaaagcggaagccgtggagtgcctgatccgtgggcctattggcgagtcctgccctgccactgcgatgagaaaacatgagggggcttatctgtatcttgactcggactccgcaaaatacattttataatatttgccgcaatcagattttgcaggataaattgataaaaaggagaacgtgatggaactacatatttatgacaactcggtggaattgggaagagacgccgctgaatgtatcgcaaaaaagctgaatgaagcgattgtaaaaaaagggaaggccaggatgattctgtctacaggggcttcgcaatttgatatgtttcgatatctgattgatcaagacgttgactggaagaacgtggagatgtttcacctggatgaatatatcggtttatctgaatcacatcccgccagctttcgaaagtaccttcgggaccggttcacgaatattgtgccggtgaccccttactttgtaaatacagaaggagatatcagggcgaatttagaggcgctgaccggggagctcagaaaagaagcaatcgatgtgggggtgatcgggatcggagaaaatgggcatatcgcgtttaatgatccgcccgccgatttcgatacaagagaagcgtacaaggttgtggatctggatgaaaaatgccggatgcagcaggtaggcgagggctggttttcatcattggaagatacccctgcccaggcggtttctatgacaccgtatcagattatgcaatgtcggtgcattgtgtcagttgttcctgatgggcggaaggctgaggcgatccggaggacgctggaaaccgaaggcgtgtccaatgagattccggccaccctgttgaaagaacataaagaatggtatttgtacctggacagggagtcggcgtcgggatttttatcagtgcgctgacctggcgaacggacatcatacaaataaaatcaaaaacggagagttcccggaatctcagggaattctctttttttaatgagacttttgatgaattcaggctgccgatgcagtttcactatttgccgaaaattgacaaaatattatcaaaattgactgtttataaaacagtaatactaaaaaatgtaatacaacattacataagttggacttcatattgtgcaaaatgacgcttataattaaaatgtaaccaagataatacaatttgggtcgggactgagcggaaaggaaggaaaagcatgctgaattccagcactgttcggttaatggagtacatttccacattaagcaaaaagacggtgagcatcgatgatatctgcgccgatctgaaatgcgccagaaggacactctactacaacatccacaagctcaatactattttgaaagaccatggctttcagaccattgaattggggagtggaattctgcgggttccggatggattggaggcgggcgcgcggacggcaatcctgtcctctgacccggaatacgtcttttcgtccgaggagagaaagtggatcatcagtgtaaaagtgggaatttccagccggccggtaacagttgagaacctgatgcagctgctgaatgtgagccgcaacacaagtttggcggaagtgacggagctgcgcggcattttaaagcagaaggaagtgttcctgaaaagccacagcacgggcggatacgatctggacggcgacgaaatcatggtgagaaacacggtgatcgagtgcctgaatcagccggagaacctcaagatgcatcagatcatggaggagatgatcacggaggcggtgaatgagaaaaccggcctaaaccgtgagagcaatgagctgtttggtgcgctgcggggaatcatccagtccgcggaaaactgtaccagcgggcagttcagcagcaatgcggtgacggagatcgcctactacctgtgcattgtatatctgagacaggggaaaaacggcgcggtcacaaccgatggagagatcagccggctgccggaatacagggccgcagagctggtaaccggccggatggaagcgctgggaatgaaaatcgtagaggcggagctctgttacatcgccacggttatgatgggggcgagactgcagcaattcaatgaaacctatggaaaccgcgaacccattctctcggaatttgcggaggatctgctcagaacctttgaacagaaggcgctggtggaatttcctgacaaaaccagactgaaggaacagctgatggttcatctgcgccctatgtactaccgcctgaagtattcaatccacgtggatcaccagttcagcggaattatgatccagcagtaccgggatttgtataacctgacggacctggctgtgaaaaccgtggaggacaaatacggtttccgcgtgccagcggaggagatcgcgtatctggcaatcttcttcggcagctttgtcaagtatcacggcagccgcgagaaaagtcagagcggtgcaatcctgatcgtgtgcgccgccggggtcagctccgcgatgctcatccggcagcagcttatttttcttctgggttcaggatatacctatgaaatctgtgacaaacggcatgtgtcggaggaactgttggacgaatactttcttatggtatccgcggtggagctgccctttgacagcccgaagcttgtctatgtaaatgcggttttaagcctttcccaaaaggagaaactgcttcaatacagtatcaaaaatgaggcggacccggccggctccccggacattcaggatctgctgcagattgtgggcagatacgccagggtgacggatcagaccggtctggccaatgaattccgcagatatctgaacgggagctaccgggaagacagaagcctgcgcctcaaagatgtgtttaaacgcaaatatgtgcgtttttcagataagttttccgaatggaagacagcggtccgggagtcctgtcgccctttggcggaggacggagttgtcaaagacgggtatgcggacgatattatccgcctgatggatgagctggggctttacagcgagtacataccgggcattcttctggcgcacgccaaacctgggaaatatgtgcagtcggtgggaattgcgctgacgatatttgaacagcccatcgaattccggaaatgggatggcagaatcaaagcggtgttcgtgctggccacagttgacaatcacgcgcattttaacgcgctccagacattgatgaaggtgctggcggaggaagagatacgcggtatgatctcggatgccgacgggagccgggattgtctggaccggatttttgactattttatcgggaaagaatcgtcgtttgaatcatgagaaaggtgtgaacggatatgggaaattggattcaggatatgtttgggacggataaagcgctgatcgggctgtgtcattttctggcgctgccgggagatcccctctacgatgaggacggcggtatggaaaaggtttatgagacggcgcgaacggatgtgctggctcttcaggagggagggatcgacggcatccatttttccaacgagttcagcatgccgtatatgctgcaggcgaacttggagaccgtggcggccatggcggagctgatcggggagctgaagcgggatgtgcgcgtaccctttggctgtaacgtgatcagtgatccaaaagccggagtggctctgtgcgccgtgacgggggctgggtttatcagaggcaccttcaccggcgcatacgccaccaacatggggatctgcaattccgagggtggggagtgcgcgaggctgcgccattacctggggagggacgatctgaaattcatctattatgtcaagcctgaatcgtcgggagacctggggggaagggatgcggtggaatccatgaaagccgcctattttctggataaaccggatgcgctctgcgtggccggccccgtggcgggaaagaagagcgacgcccagctgatggcccgggtgagggaagcgtttccggacagtgtgattttcgccaatacgggtgtgaatcccaatacgattgaagaattatttacatacgcgaacgctgcgttcgttggtacttacctgaaaaaggacggtgtatttgaaaatgccgtggacccggagcgggtgaaacggctgatggatcaggcaaatcaactgagaaagtgagggcatgtgtatgaaaacggtcgtgataacctgtgcatccggaatcgccacgtcgacgctggtggtcaacaaggttaaaaagctgtgcgacgacaatcagatcgactgcaggattatccagtgcagctatcaggaactggcgaagttcgcagattcctgcgatgtgattgtgtccaccctgaagatggaaaatacctttaacaagcctatgtattttgcagtgtcctatattaccggcataaacgaggcaaagctcaatgagcagcttttggaggagctgagaaagtagagggagcgggatgaatggattggaatgtatttacccgtcgatctactcctccgatcatctccgccttttggaggaaatgaggtgggtggaggcggaggggttttcccacctccatgtggatatacaggacagcagcctggggctcaatctatcgtttggaatgaaggtagtccgcggcttggctgcgctcacatccatgaaacttcaggtgcatctcatggtctatgatccgttgccctttgtggaacagctctcggagctcagtcaggtggaggaggtgctgtttcatccgggaaccgtgcgctatccgggggtgattctggaccggatccacagaatgggcgcccaggccggctttgccctgacgccctcggagaatccagtggagctggattactaccggcatgagctggattccgtgctggtgtggacgggggagggaggaatgggggattttaacccgggctcccttgccaaaatcaggagagtccgcagtatatttggggacggggtctctgtgtttaccgacggggatatgaacgggaaaaccatacagcgtgtgagggcagccggcgcggatcattttatcgtggggagagatctgtttcaggctgtggaccgccatgagaaagtaagggaattggaacgtattgtggggacgttttaggaggtattggtatgaatagtctattagaactattggtaaaagcggggaattttgtgtcgaatatcggcagtatggtgatgattccggttattttggtgattgtggggctctttttccgaatttcgcttcccaaggccatccgctccggcctgctggtgggagcgggctttgtgggactgaacctggtgaccgggcttctgaccagcaatatcggcgtggcggcaaagctgctgtttgagcgttttaacctgaatctgaaattcgtggacgggggctgggcggccgcggccggcatcgcctactcaacggaggtgggggcgctcattatccctgtgattctggcggtgaacattctgctgctgtttctgcacctgaccagaacggtcaatatcgatatctggaatttctggcattttgcgtttgccggctccatggtcatggtgctgacggggagcatgttttacggattcctggccgccatcgcgtactgcgtgttttcgctccggctggccgactatatcgccaaaaatatgcaggatgtcctgggaatggagggcataacgatcactgagtccgcagctatcgcgacggcgcccatcgccatggtcatggataagatatacgatcatatcccggtgttaaaggacgccaagggtgacgtgaaagcgctgaaccggaaaatgggcgctctgggcgaaccggttgtgatcgggtttgtgctgggcattgttttaggcgcagtgtgctcctacagcttccgcgagacggtggagctgggaatcaatttgggcgcggtgatgttgatgatgcccaggatggtcaaggtcattatggaagggcttcttccgatctccgaggcggccagggaatttatgcagaaacggttttccggggaagagtattatattggactggattccgcgctggcctgcggtcatgaaaactgtgtggcgatttcggttttgatcattcccttctacattttgtttgcaatcatcacgcccggcaaccagacccttcccttcggagcgctggcgggaaccgttttcgccgggtgtattacaaacggcatccaccggggtaactttgtccgcacctatctgacctgtattatccagacggtgatcggcctgtatatcggcaccctgatcgggccgctgttcacggagctggcgaaaagcatcggctaccagttcccggagggcgcaaccggaatcacctactattgtccgggcggttgggcgtactccaccattatttacagcatgaaatataaaatgatcggcgttgtaatcgttgcggtgcttctggtaggctggtattatatcaccagagagaagtccgcggacaggaaataccgctttatgacggcgaccagaaagtaaggagagttctatgagtgcaacagtaaaaggggagttaatcgctgcggattccgtgatgtgcagagtgagggccggttcacgggacgaggtcctgaagctggcggccgatcacttaaaacaggcgggatacgtgacggacggatttttccaggcgctgcttgagcgggaaaatatgttccccacgggaatctgcttcggagacacctgcgtggcaattccccacgcggaaccgggattcgtgaaaaaaccggtgatgctgatcatgaccctggagcggccggtccgctttgtgaacatggaggactgcgaggcggaaattccggtggaaatcgtgtttgtgcttgcgtttacagacagcgaaaagcacctgaatgtgctccagcgcctgtccgccctgatccgcgattccggcacggcggcggccctgcgggaggcagggaatgagggaaagctgcgggaagtgttgaggaacagcgagctggcagcgttttggcgggattgagaaaaggagggagtgggctgctgccttagggggcgacggtccattccctctgttatccattttaattattgggagcttttgaatacgttcacacaattactgaactgaaaatccctcataagcttcccgcaggatatcagcgatttcattgtcgctcaatttaccgcgattcgtatcattcaaatcaaaccaggaaaaacaggccgcccttttatgaaagtccgcaaatatcgtttcctcaaaccggtcataggcacgctcatcaatctcgttaccgtctgcatcttcacaggtaatgatcgcaaatgaatcggatatgtcttcatcataggtgcttttgtatgcgagaatacgctccgagagtgttccgtctgctaaagaaatcgcccgcttgttttcggaagcgtaatggattccgtccggaatccggtcctgaaaaatataataaaatatctcattatttggatcataatataccggaacgctgcttaccattacgtcggcttctgattcaaagtttcgatctggccattcacagggcgtcaaaccgtccagctccttgtttacctcataataatcactgtatgtgtatcgccccgatccctcaagatgggaaataatcaactccaatcttccgttctgatccaggtcagtcacagtaaacatgcggcagatattgccggacggcggacaactccactcatagttgtctaacatcacctgcagctgcctttctatcgttatgtctgaaacttcattgcctgaacgaatactcatattttgtatgtaaatttggctgctgaatcccgctaaagccaaaagaaggaacgctataaggattttccatttgcttttcaactacatggcctcctttataaaaaacggttgatgcgcatttattttcacctcagtctgagataagtatagcatataatgttacagaaaaatggagaccaaacgatctttctgtaaaaaatgcgccgggatttgcggccgggatctttatcaccctcatgtaggcgctgttgcgggaatgtttgtaggcgctgttgcgggaatgttccacttgataaatccccctcttaatgctatactataccggttcatatgcaggcggacaacaggctggtttcaactttctatttgcagcccgcatatgtccgcaataaggccgtgaccccccctggcaatacaggggatttcacaaaacgaccggtgtgttcgagaccttccacacctaaaacaaaactaaaggagaaaaccgaatatgagagagagcaacaaaaatgtgtacctgattgtccacggagccgccattgcggccatctatgtggcgctgaccatgatattcgcgcccatcagctttggccctgtgcagtttcggatctcggaggcgctgtgtatcctgccattcttcacgccggcggctgtgcccgggctgttcatcggctgcctgctgtccaacctgttctgcggttcggccatgctggacgtggtgttcggaagcctggccaccctcatcggggccgtggggtcctggcatctgcgccgccacaaatggctggtgtgcctgccccccattattgccaacaccctgatcgtcccctgggtgctgcgctatgcctacggcgctccggatttgatcatctatatgatcggaaccgtgggaatcggcgagattctggcggtgggcgtgctggggaacaccctgctggcggctctggaccgttacaaaggtatcattttcagacatacgccccaggcggcgcgctgacctgggactgaaaaacggaccgatgaaattaaaaatggagagttcccgatcctgggaattctcttttttaatttcccctcgtttgtccgccacgctcgtcctgcaagttgtcgttgaaacactctggaaattcccgtataatgggggaaacagaaaggcccgcgatgcggcggccttccacaacaagggaggggaacattatgctggaatatccggagatcgcagtgatatcccgccagcttcagaaggagacggcggggaaaatggtgacggcggttttgccgcccatgaagccccacaaattctgctggtttaacggggacccggccggctatgaggcgcagcttacggggagcaggattacggcggcggaagggtttggaatatttgtggagctggtgttcgacaacggcagacggctctgctttaacgacggcgtgaacgtgcgcctgaccggcggggaaaagccgcccgctgcctgccagttattgatccgcctggatgacgggaccgccctggccttcaccgtggccatgtacggcgggatctatctgcatgacgggagctacggggacgaatactatgtgaagagccgggccgcagagccgcctctctccaaagcgtttgcggcccgctatgaaaaagccctgggggaagcggggccaaagcttaccgccaaggcgtttctggctacggagcagcgtttccccggcatcggaaacggcgtgctgcaggacatcctgtttcgggcgaacattcatcccaggcgcaggctggagtccatgagcggggacgaaaaagccggactattggcggccgtgacgtccgtgctggggaaaatggagacggcgggtggacgtgacacggagaaagatatctacggccagccgggcggttaccgcaccatcatgtccaaaaacggcatgaaatccggctgtccggcctgcggcggttccattgtgaaggccgcctatctgggcggctccgtgtattactgtcccgcctgccagccggagaaaacggaggcgtaaagcggcggctgggataaaggaaaggatttaacgtatgttgtatcagatttcggacggaaccgtgagcgccggcggggaagtgattttgtctcacatcgattttgaggtccgcggtgcggaaaaaatagcggtggtgggtaaaaacggagctggaaagaccacgctcctgcgcctgatcgccggggaaatggacctggaccgcgacgaccgccgccaggggccgggaattgtccgggccaggcaggcgaccatcggcatgctgcgccagcaggcgttttccggggacgacaggaccgtggaggaggagattttgtccggctgcccggagcaggatccattttccagggaacggtttgagtaccagcgggagtacgaggcgctgttcaccggcttcggttttcgcaaggaggaccgggtgaagcggctgtcccggttttccggcggggagcggaccaaaatcgcattgatccgtctgctgcttgacaaaccggacattctgctgttggacgagccgaccaaccacctggacttagagacagtgaggtggctggagcagtatatgaggcgctatcccggagccgtggtcatggtgtcccatgaccgcttttttctggaccggacggcggatattgtctatgagctggaggaccggaagctgacgcgttacgccggcaattacacggcctaccgggaggaaaagcgcaagcgccggaagctgcaggccaaggcctacgagcgccagcaggaggagtttaagcggctggaggagttggtggagcgttttaagcataagcccaccaaggcggcgtttgccagggccaagcgcaagcagatggagcgcatggagcgggtggaaaagccagcggaggaggaaggcggcttttttaccggggatatcacgcccctgattcccggcagcaaatgggtgtttgaggcggagcacttaaagctggggtatgaccggcagcttctggagctgagcctgcgcatccgcaggggccagaaaatcggcctgctggggccgaacggcgccggaaaaaccacgtttttaaagaccattgcgggatttattccgccggtgggaggggatttctcactgggcgtgaacatcaccatcggctattttgaccagcgcgccgctgagattgagtcggagctgtccgtggcggagcatttccaccgtctgttccctgtgatgacggagaaggaggtgcgctccacgctgggggcttacctgttcggcggccgggaagcgtcaaaacgggtcagcgacctgtcgggcggggagaaggccaggctggtgctggcggagcttttgcagagccgccccaatttcctgattctggacgaacccaccaaccacatggatatccgggccaaggagacgctggagagcgcctttcaggcataccggggcacgatcctgttcgtgtcccacgaccggtattttatccggcaggtggcggacgcggtgctgattttcgacaaccacagcgccatgtattatccctttggctacgaacattatatcgagcgcctggaaaaggaggagtccggtcaggatatctcggctatgatttcagccgaggaacaggcgctgattgcgggacttcgggccgttcccaaggcggagcgccaccgcctgcgggagattcccaccgaggaggcttaccgggactggaggctgcggctgacagcggagcagatggaggccgcgggcgggcggtttggggagttggagcagatgcgtcaggcgctggaaaaacggtggatggattcggaggcgttctggaccggcgcgcgctgggacggggagacggaatatcaacaggttttgaaggaaatggaagaaaccgggaaccgctggcgcgacctgtgcctggaatggtgggacacgaaaaatggagtggacacgcgatagaggaagatgaaaaaatgacagcgccgccgggcggggattatatccccggaaaaccggcggcgttgtgagtctccaaaaaccgctccaattcccttctggtgaccggaatgccgtcgcgggaaccgatcatagggccgcggccttttgaatcaggtccttccgggacggccagatagctgggaacggcgatcagccgcagggtttcccaggcgtagcggttgccctcttccaccttgccggcgtagcggttttgatccagcgcttcctgaaaggctttgaaatccgcgccgcagcggacggccaacccggcgagaacaaaatggtcggagatatccaggtccttttcaaagtgcgcctcgtacaccagccggtgataggaggagagatcgccgccgcgctcctccaggtaatacatgccctggatggccatatcgctgtggcggtaggtattttccgggcgcgggtgggactcgcaggggcgccagaccacctccagcccggggtacaggggcagcagttccaggaacatccggtgtccgcggtagcagtaggggcagatgtagtcgaagaaaagttccagtttcatgggagaacctcctttgcggtgatgagtgaaatcgggaaaggccggcggcaatgtatgatgattgagtatagcagacagggacgcgggattcaagggccggaatttctctgttttttgtgtggaatttacgcgggtttttggtataataggcatagatgtgccttgggaggcagtcaaaagagatttacacaacatactataattatatgcgcggaagaatttttccagtttttgttaaactggcgatttacgggcagggaaaggaaatgaatgatgtatcagatagattttagcaaacggtcacatgtgcattttattggaatcggaggcatcagcatgagcggtctggcggagattctgctggacgagggatttacggtgtcggggtcggattcccatgagacggagctgaccgaccggctggaggccaagggcgccagagtgtattacggacagcgggccggcaacattgaacaggagccggggattcaggcggtggtgtacacggccgccatccacgaggataatcctgagttcatcgccgccagggaaaaggggcttcccatgttgtccagggcggagtttctgggcgagatgatgcgcaactacaagcagtccatcgccatttccggcacccacggcaagaccacaaccacctctatggttgcggaaatgctgttggccggggacatggaccccacggtgtcagtgggcggaattttaaaagatatcggcggaaatatccgcgtgggcagcccggatttgtttgtaaccgaggcctgcgagtataccaacagctttttgtccttttatcccacgctggaggtggttctgaatatcgaggcggatcacctggatttcttcaaggacctggaggatatccggcactccttccgcctttttgcgcagaagcttccgcaggacggcctgctggtgatcaacagcggcatcgagaatctgcagcagatcacggacggcctgaaatgcaggatcgtcaccttcggatcgtccccggacagccattacaccgcgcagaacattacatacgatgagttcgcccgcccgtcgtatgatctgatcgtgcagggggaactggtgaaccgcgtttccctgggcgtcacgggcgagcacaatgtttacaattccctggctgccatcgcggtggtgatggagctgggcgtgggctttgaggcgattatggcggggcttaagaatttttccggcacggaccgccggtttgagaagaagggggagatcggcggcgtgacaattatcgacgattacgcccatcacccccaggagataaaggcgactctggccgcggctaagaattatccccaccgcaagctgtggtgcgtgttccagccccacacctacacccgcaccaaggcgtttctggaccagtttgccgagacgctggccgcggcggacgaggtgattctggccgacatctacgcggcccgtgagacggacacattgggcgtcagttccgcagatattgccaggaaaatccaggaattgggaacgcccgttcactttatcccgtcctttgacgagatcgagacatttattttggaaaattgtatgaacggcgatttgttgataactatgggggccggagatatcgtaaaagtgggagaaaagctgcttggcatgtagttatccacattatccacagagttgtcaacattttatgtaaagatatgatgtggattgttagattgacataaaaaaatgtcgcacgattttaaaaatcttggttttatatggggaatccgggcgtttgagccgttgagtgcacagcggtccaccggattttccacattatccacattatccacagagggatgtgtgcataactgccccctattttctttttttgggggatgtgttatgatgatgacaagattgacagccaatatcccgcgcggcgcgaggcggtttcacggaacgctcttttgagcggagattgggattgcagcgcgcggcagcagcttatccggaggtgtaaaggatgacgtttcaggtgaaggacaggtggaatatccctgttaccgcggtggcggacgagtttatcgatctatatatggccgcggccaatggagagtatgtgaaggtttatctgtatctgctgcgccatcagagcgaaccggtcagcgtggacgccatcgcggatgcgctgaatcatacggaatccgatgtacgccgggccctggcctattgggaaaaggccggggtcttattgcgggaggacctgctcttaccggacagcagggaaaaggacgcgggatcggcggaggaccgcccgaaagccggtgcggttttggaacgggaaatgtccggcggccggggagcggcgttcagcgcagacccgcaggtcagtccagacagccgcagcactgcgtatcatggatccacacaggccggagcggacggttggagcgcgtcctacagcggagccccccaggccgtaaaccagactgcccctgctgccgtccagccccagggtgcggtttcggagcctgcgccggcagccggacggacggacagcgtttcctttggtgcagcccccgcggcggccgctccaagccccaagccggtttactccgtggcccaggtgaaccgcctgtccggcgacgaggagtttgcccagattctctacatcgcccagaagtacatgaacaaggtgttcacgccccgggactgccaggtgtttgcctacctgtacgacactctgaaattcagccccgagcttttggaatatctggtggaatactgtgtccagaacggccatgtaagcgtccgctacatggagactgtggccatcaactggcatgagcagggcttcaggacgccggacgaggctaaggagtacgccgaaggctttaacaacgacgccttcagcgtgatgaaggcctttggtctgaacgaccgcaggcctgccacggaagagcagaagatgattaccaaatggttccgggaatacggatttggccgggagctggtgctgatggcctgcaaccggaccatttccgccatacatacccccagtttccgctacacggacaagatcctgtccgattggaagcaggcgggggtccgcaccaaagcggacgtggaagctctggacgagaagcgctccaagtcccgggcccaggggacgggcggacaggcccagggaggcagaagctccgggggccagggcgcaggccaggcagacggcggccgccgcaagtccaaccagttccacaacttcaagcagcgcgacacggattatgatgcgctggtgttaaaacagctcaaggagcgcgtaaaccagcagtagcgatatggagatagggcgtccggaaccgccggacggcccggcggtcccggaaagcccggcggccccggaaagccccagcgatcccggcccccagcgcccctcacccctctcacctcagcaaggagatacaatcatggcactaagcaattcccaatacgacgcgattatgcgggaatacggaaaacagcagatcgagaaccggcaccgccaggaggagcgccgggcacaggtttacaaggcggttcccgcggtgcgtgagctggaagccgagatcgcgggccggtcggtggcctgcgccaggaagcttctggagggcgatcaaagcgcccttgacaagctgcgggcggatttgcaggacttaaaggaacagaaggctctgttaatccgggcggccggattcccggacgattacctggagccccattaccgctgcccggactgctgcgataccggctatgtggacgggaagaaatgccactgcttcctccaggcccagatgaagcttctctacgcccagtccaatctggagaccgtgctggaccgtgagaatttttccaacctgtccttctcatactatgacgactcggagttgattccgcagatcggcatgacaaacgcccggtacatgcggcaggtggtgggctggtgcagcgactttgtgcgggatttcggcaaaaaacacgacaatctgctgttcaccggcagcaccggcgtgggaaaaacctttctgaccaactgcatcgccagagagctgatggacaagtattattccgtgatctacctgtccgcctcagacttgttcgaagtgttctcacgcaacaaattcgattaccagcccgaggacgacatgaaggatatgtaccgctatatcctggactgcgatctgctgatcatcgacgatctgggcacggagctgaacaacagctttacctcctcccagctcttctactgtatcaatgagcggatgaacatgaagcgttccaccatcatttccaccaatctgtccctggccatgctgcgggacagctacacggaccgggtgacctcccggatcatgagcggttacaccattattcccctgtacggcggggatatccgcttgctgaaaagctaaaaagtttaaaagggcgggaatggcttgacgaaaacacgcccatgatgtataaatgatatgttcacaacaaacaggaggataaaaacacatgctgtacgaggaaaagatcattgaaaccataccggtaggaccgctgggactgattccgcttaagggtatttccgagctgggagaaaaggtggacaggtatctggtggaatggagacatgagcgggagagcgagcacaaatcgactatcgcattttccggctaccagagagagtcctatatcattgaggccaagacgccccggttcggttccggtgaggccaaggggattattacggagtcggtgcgcggagatgatctgtatattatggtggacgtgtgcaattacagtctgacctattccctctgcggcatgatcaaccatatgtcgccggacgaccatttccaggatttgaagcgcatcatcgccgccgccgcaggcaaagcccgccggatcaacgtgattatgcccttcttatatgagagccgccagcacaagcgctccggccgcgagtccttggactgcgccctggccctcagggagctggtcaacatgggcgtggagaacatcatcaccttcgacgcccacgaccccagagtacagaacgccatcccgctgcggggatttgagacggtacagcccatttaccagttcttaaagtacctgcttaaggtggagaccgacttacagatcgacagcgaccacatgatggtcatcagcccggacgagggcggaaccggccgcgccgtgtacttcgccaacatgctgggactggatatgggaatgttttacaaacgccgggactacaccaagatcgtgggaggccgcaaccccatcgtggcccacgagtttttgggctccagcgtggagggcaaggacgtgctgatcatcgacgacatgatctcctccggcgagagcgtccaggacgtggccaaggagctgaagcgaagaaaggccagaaaggtgtttatctgcgccaccttcggactgttcaccaacggtctggccaaatttgacgagtattacgagaacggcatcatcgaccggattctgaccaccaatctggtgtaccagaccccggacctgctgtcgaggccgtactatatcaatgtggatatgagcaaatacatcgcgcttattatcgacaatttaaaccacgacgcttccttaagcgagcttttgacccccaccaaccggatcaacaagctgctggcgaagtatcgggagggacgcggctgacgccggtattttccggcgcagtgcgcaagtaagaccgaaaggaatcgtgcctatgaacgaagaacaattccgcagcaggatctactgggtaacctttttattcagcatgctggtggtgtgggttcactcctacaacggggaattgtttctggggctgaccgggcaggctgccgtggtggaccggattgagcgggccgttggggaacaactgggacagatggctgtcccggggttcttcatggtctccgcctatctgttctaccggcggtttacctgggagaaacttctatataaatggaagtcccgcgttcacagcgtgctgattccttattttttatggaattttctctactacatggcctacgttctggccacccgcatacccgcgatcacccgcctgatcgggaagacggcggtgccctttgacgggggacagctggtcagggccgtggcgttttacgggtacaatcccgtgttctggtatctgttccagctgattctgctgatcgcgcttgcgccgcttgtctggctgctcatgcggtcaaatgtgacggcggcgctgactttcgcggccctggccctgatgatctggaagggccggtatttcccgcttctgaacgcggacgccctgttctattacagcgcgggggcctgggcggccctgcaccgggaacgggaggggagatttgttgagagcggccggatcggggactgggccgtggccgcgggggtcctggcttttctgggcatggctgcggtattgtttggcagaccgggcatggcgctctggcagaacccgctgcaaacggtgctgatccgctttgttatggcctcggcggcctggatggccgtgagtctggcgcctcttcctgcggcctttacctggatgaagcagaatttctttctctacgccatccatttcgccctggtgcgtctggtcaacaaggcgggggcgctggtgctgggcggaaatgcagccgcggccctgggcattttcctggtcatgcctgcggttatggccgttgcaagctatgggctgtcccgtttgctggggcggtttatgccgggggtgtacggggtgctctcgggtgggcgcggggctcaataagaaacggcccgggtctcccgtgcggtctgatcagatgtcagccgtcatgagggatccgggccgttttccacacttccatccatttttcacgctccccgcttgcatcacccggcccttcatggtatgataataacacttctgcggaagttctttccgcgagatgcttctgattgaatccgcgcgcagatcgccgcattttcacagaaaagaaattgtaaaccacagagagaaagcgggaggtggggcgcctatgcctggatgaaattaatggttgacattttaatggaactatactatgatgataactagaaaaagaacatttgttcgcattggaggacgctatggcgaaagaagagaaagtaatggtcaacaaccgcaatatgaatcgtgaagataagctgaaagcgctggatgcggcgctgactcagattgagaaggcatacggcaagggctccgtgatgaagcttggagattccggcgccaatatgaatattgaaactgttcccaccggctccatcagcctggacatcgctctgggactgggtggagtgcccaagggcaggattatcgaggtttacggccccgagtcctccggtaagaccaccgtggccttacatatggtggccgaggtgcagaagcgcggcggcatcgccggtttcatcgacgccgagcacgccctggaccccgtctacgccaagaacatcggggtggatatcgacaacctgtacatctcacagcccgacaacggagagcaagccctggagatcaccgagaccatggtgcgttccggcgcggtggacatcgtgatcgtggactccgtggccgccctggtgcccaaggccgagatcgacggcgagatgggcgactcacacgtgggactgcaggcccgcctgatgtcccaggccctgcgcaagctgaccgccgtgatcagcaagtccaactgcgtggtgatctttatcaatcagctgcgcgagaaggtgggcgtgatgttcggcaaccccgagaccacaaccggcggccgcgctttgaagttctactcctccgtccgactggatgtgcgccggatcgaaaccctgaagcagggcggcgaggtgatcgggaaccgcgtccgggtcaaggttgtgaagaacaagatcgctccgcccttcaaggaggccgagttcgacatcatgttcggaaagggcatctccagggagggtgatatcctggatctggcggccaaggacaatatcatcgagaagagcggcgcctggttcgcctacaacggctccaagatcggtcagggccgtgagaacgccaagcagtatctggcggacaatcccgacattctggctgaggtggaggagaaggtgcgcaccaagtacggcctggctccgtcccacgagggcctgccccagcgggaggaagaacccaagctgctgttcgacgaggccggcggcaagaattaagcctggttacaaccagggccggattctcccggcgttgcatcggattgcggcgccgggctgaatcccggaacatgcaagtaaaatcgagaggagcgtggaagctatgaccattacttccattgtccccgtggataaacgaaagtgcaaagtctttgtggatgaaggctttgcctttgttttatacaggggggagatcggccggctggggctggcggaggggggaaccctgtccgaagagctgtaccggcagatcgagaccgaactgttaaaccgcagggccagggagcgcagcgtggacctgctgaaggcctcggacaagagcgagagccagatccgcagccgcctggaggaggacgggttcccccagcctgtgatcgaccgcaccatcgccctgctgaagaagcaccgctatgtggacgacgaggcctttgccaggcgctacgtggagaacggcggcgcgcgcaagagccgccgtcagctggcctacgagctgcgccaaaagggcgtggacagcgagttggtggaccaggctctgcgggaggcggctccgcccgaggaggagacggtccgccgtcttgtgcaaaaaaaggtgggcaatccgggggagctttcccgggaggaattgcagaaattgtacgcatttctgggccgtaagggctattcctacgaggtgatccgccgggtgatcggcgaaatctgcgacgagtaccagtgacaggctgttcctaaggcctccggtggttttgttcatattgtctggatttgtacgaaaacagggtgaatatacttgacacaatactgaaaaacgtataaaattaatatgttgtagttcgtacaatgaaaatcaaatagaggaggtgctcctgtgttgcagatagtggtcccatcactgatagtcgggataataatggctattattgcttggtttgccgcccgttcctatgaacggaagcagtacgacagcaaagtcggaagcgcggaagaaaaatcaagagaaataatagatgaagcattaaaaactgcggagacaaagaagcgagaagctctcctggaagccaaggaagaatccttaaagacaaagaatgaattagaaaaggaaaccaaggagagaagagcggaacttcaacgttacgagaagcgcgtactgagcaaggaagagaacgttgaaaaaaaggcagatgccctggaaaagaaggaggctgaccttgtcagaagagaaaatgttctgagcaagcgcagtgcggaagtggaagcccaatatgaaaaaggcatacaggaactggagcggatatccggtctgacctccgaacaggcaaaagaatatcttttaaaatctgttgaagaagatgtaaaacatgacacagcgaagttaattaaggaacttgaacacaaagcaaaggaagaagcggacaagaaggcaagggatctggttgtgactgcgattcagcggtgcgcggcggatcatgtggcggaaaccaccgtttccgtcgtacagcttcccaatgatgagatgaaaggccgcatcatcggccgagagggacgcaacattcgtacccttgagaccctgacgggcgtggaattgattatcgacgatacccctgaggcagtggtgttgtccgggtttgatcccattcgtagagaagttgccagaattgctctggagcgtttgattgtggacgggcgtattcatccggccagaatcgaggaaatggtagaaaaagcacaaaaagaagtggagaccaacatgcgggaagaaggcgaggcagcatgtctcgaggttggaattcacggcattcatcctgaactgattaagttgcttggtaagatgaagtttagaacaagctatggacaaaacgcattaaagcattcaatcgaggttgcacagctgtcgggacttctggcagcggagcttggagtggatgtacgtttggcgaaacgtgccggtttattacatgacattggtaaatccgttgaccatgatatggaaggcacacatgttcagctgggcgcagatctctgcaagaagtacaaggagtctgcgaccgtgatcaacgcggtggaatctcatcatggcgatgttgaaccgaacagtctgatttcctgtattgtgcaggctgcggatacgatttccgcggcaaggcccggtgcaaggcgtgagacgttggagacatatacaaacagattgaaacagttagaagatattaccaactccttcaagggagtggacaagtcttttgccattcaggcaggtcgggaagttcgaattatggtggttccggaacagatcaatgacgacggcatgatattgctggccagagacatttcgaaacgcatcgagagcgaactggaatatccgggacagatcaaagtgaacgtgatccgtgagtcgagagtgacggattacgccaagtaaatgtccgaagtaaaatgatcaatacctcaaaaccgcagcaagcgaaacgctttgcggttttggggtatttttttgattgactattctaaaaaactataatattataaaaatatagaataataggcggtggtcaattttatgaaagacatggaaaagattatttttcatccgatccgcatgcgcattatccaaatgatagcgcagagcaggaccgcgacggtggcggccctggccgagggtctggcggatatcccgcgttccacgatctatcatcatatggggattttatgtgaaaatcagattctgcatgtggtcagggagcaaaaggtccgcgggacttacgagaaggagtacggcttaaactatgatgagattgcagtcccggcagagaatacggagcgcgccgtgacgaatctgcttctgaagctctatgccggcttcagttcctatttcgcggtcccaaaccaagatccggtccgggaccagctgtttctctcggtgaataccctgatgcttgcggatgaggagttcgaggactgccgccgggagctgtttgacgtgatccaaaaatatatgaaccggcccgctgcagagaatcggaggccaaggctgctctccgtggtttccgctccctgcgcgggagagcaaaagggcggctctgagaaggaggaaaaagcgtgaaggcggcggtgcgcaggacctttggccttttggccggtattttaatttactatttggtacacgaaggggcccatctggttctggcgatggcctttggagtgtttcaggaggtacgctttctggagctgggcgtgcagattgccattaccagccgggaggcgctgtctgatctgcagtttgccgcgtttaacgcggcgggagcggggacttcccttgccatggcctacatactcgttctgtctgccgggcggataaaccggctgcatggcaaggtggtaaaggcggttggttactacgcgaccattctgcttctgctcaacgatcccttttacctgtccgtgctctgcggttttgtgggcggcggggacatgaacggcatcgtcatgttcgggatttcagagacggcggcccgcgtggcattcggcgcgctggggctggtcaacctgggaattgtatggaagtatgtgctgcccgcgtaccgggcgggatttgcgggcgccggagacagaaacctgtgacggggcgcgcgtatttggaagaaaatcaaacggacggctggtatagcgtttgggaggaaatcgaatgggcggtttgatttattatatcgaggacgaggaggatattgcctggggggtccgggaatatctgcaaaaaaagggatttcatgtggaagtgctgggtacggcgggggaagcgaaggcggcgttggaacggaagctgccgtctctggcgctggttgactggaatcttccggacgggagcggggaacagctgtgcagatggattcgagggcggtggaaggagctgccggtgatctttctcacggtgagaggggagtccggcgatatcgtgcggggctttgagaacggagcggacgactatatctccaagccctttgacttggcggtgctccacgcgcgtatccgcgccctgttgaaacgggcaggcaagggggagacggcccgcttaagctgtgggccgctgtccttagataccgggacggtgaaggtgtattgggaagcccagcccctgccggtcagtccggtggagtaccggctgttggagattttgatacagaatcagaaccgcaccgtcaccaggcagagcctgttggagtccatttgggacagcagcgggaattatgtcaatgacaataccttgacggtagccatgaaacggctgcgggaaaagctgcctcggccggattgcatccgcaccgtcaggagtttcggatattgtatggaggaggttgaaacatgagccgaacgtcaggccgttttgcggccaccggttttgccgccggctttgcgctgggaggcgttctggcggcctgcgcctatgtagcctgggccgcaggccgtcaatacgggcagtttgcgcggctggccggacaactgtcccggcggtggcctggaaatgagacggagattgtggggatgatcaaggcggcggccggaagcggcggagacgacgtggcggcaggaatggagcttttgagaagctacggttttgaaccggtccggctggcctccggtttcggcccgggtacggtcctgattacgctgacgggattgggagtattcctgggaatcctctggtgggcctggcgcagagagcgcgggaggaaaatcttacggatcggggagctgacggcttatctggagcaggccagccggaaggagggagcgggcctcctggatgggcgggaggacgatttttcgccgctgcaggatgagatttacaagacggtgaccgcgctgcgcctggcggcggagcgggaagagaaagcccgccgggagtttgcggaccggcttgcggatgtggctcatcagatcaaaacgccggttacgtccatcgccattaccgcccaagcgttggaccagacggaaaatgatccgggcctgaaccgaatccgcaggcagacggagcggctggagcggctggtggaaacgcttctgacctttgcccggatcgattccggcgcgctccggctggaaaaacaggcggtggacgtgtacacggcgctggaactggctgcggagacggtggaaccggttctgcgccgcaggcagattgatcttgagatccccaaccacccggggatttcattttcgggggatctggaatggacggcgcaggcgtttaccaatttgttaaaaaactgcgccgaccacgcgccgcagggcgggaggatcgccgtggattacggggagaatccgctttatacggagataacggtccgggataacggaccggggttcgcgccggaggagcttccttacattttccggcgattttatcaggggaagaggagcccggacgggagaaggggaagcgaggcgggggatgggaggccggccgaaatgggagcggcgcagggggaggagccggggcacggcagtccgcccacttcccggctgactcaggaaaggggcgtcggcctgggtctggccctggccaagtccgtgatcgagctgcagggcggttttatcgaggccaggaatctgccggaggggggagcctgctttaccgtgcgattttactgtcaccgggatgtcacttttctgtgataagctgtaattatccgattaaaacagcagacagaaggaggaatagggcttggagatattgcggtgcgaggctgtgaccaaggtgtacggcaggggtgcaaatcaggtgaaagcgctggacggcgtcagcctgtccgttgaaaaaggggagtttgtggcggtagtgggggcttccggctccggcaaatccaccctgctccatctgatgggcggtgtggaccggcccacagaggggcgggttttcgtggaggatgaggacatttccactctgaatccggtgaaggcggcggtattcaggcgcaggaaggtagggctgatctaccagttctacaatctgattcccactttgagtgtggagcagaatatcaagctgcccatgctgctggacaagcgcaggccggatgaggcgtatttccggggactggtggctggcctggggttggaggacaagctgaaggccctgcccgacgcgctctccggcggccagcagcagcggaccgccatcgcccgttctcttctgtaccgcccggccgtggttctggcggatgaacccaccggaaatctggaccggcagaactcccggcagattgtggaactgctgaaggggtccaaccgggacctgggccagaccattgtgataatcacccacgatgagcggattgccctggaggcggaccgcgtggtacaaatcgaggacggccgcatcgtctcggaccgccgcacggtctagggggtggcgctatgtggagactattttcactggactatatcaggcgcaaccgggccgcatgtatttccatcgcggtgacggcgctgatcgcttcgttcctgatctcggcaatcagcgggatcttttacaatatgtgggaggacgagaaccgtctgatcgccgcggaggaaggggattggcagggacggctgcggggggatctgaatggggaggctctggcggtggcggagagctttgacaatgtgagccgggcggagctggcggcggaccaggagagcggggaaatggtcctctccctctggtttgaaaatccccggagcgtttaccgggacacggagcagctggcccggctgatcggcgggaacggggaaaacggttggttgagcacccagtatcaccacaagctgttgaaccagtatttgatcttttcgccggaggagaaggaaaatccgccccaacttctgtttctttatctgggcttcttgaccgcggtatgtatttcccttgccatgatgattcacagtgcgtttgcggttaccatggagagcaggctgcagcagctgggaattatgaagagcgtgggcgctgccccggcacagatcaggaccgtgctgctccaggaagccatggcgctgtgcctgtttcctgttttggcgggaattccccttggagcgggcagctgctattggtttatgagaatggccggcagcctggcggagaacctgggagtcagccgcgccgtgggggcggtattttacttcccggctccggtggcccttttgtccctgtcggtctgcctgttcactgtgtggatatcggccaggctgcccgccggacggctggggaggctgactcccctggaagcggtgaggggaggcagggaatccgcgcctgggaaaatgaggcggttccgcctgattgcgggattattcggcatcgagggcgagctggcccgaaaatctctctatgccaggagaagggcttttcggacagcgggcatctcgctgacactggcttgctttgtgttcagcgcatttttgaattttgaggtggtttcctatcttcacacctaccatacgttttttgagcggtataaggatacctgggatttgctgctcaccctggacaagagggcggagcgggaggggatggcgggatatggactgctggaagcgctgcggggactggatggggttgagcgctgcgcggagtaccggaagttccaggcccacatccggctgccggaggacacggtgagcggggagcttgaggcactggggggacctttggggcttacggacacgggaattgtaagagatggccgggattatctggcgcaggctccgctggtggttctggacgatgtgagttttcaggaatattgccgggagtcgggggtggagctggagccgtgggtccagccggaagcgggggtgaagttggagccgggggatgatctgctcaccggcggaaccgggctgccggttgtggcggtgaaccgtatctgggataatctcaacagccgctataagaaccggcagtacgttccgtatttgaaggcggaagccgggatggaactggagcttgcgccagcccccttaaaagcccggattctcgcctacagcgacctgcccccaaatctgagggaggaatacgaggattttgccctggtgctggtggcgccggaatccggttttcggaacgtggaggccgcgttcgaaaaggcggacaggcattttaacattttgacggactcggaccaggtgattgacggagtccaggcacagattgaggggatgatggggagcgcgcccggatgggagatggaaaaccggctgagcgaggaggcgtttaacgaggcggtccggaccggttacaagctggtcatgggaattttgtgcggaatcctggcgcttgtgggcctgtccaacgtattcgccaacgccctgggcagcataacccagcgcaagcgggaatttgcccgctacctgtccgtgggtatgacgccgggaagcgtgcgccgggtgctggcgctggaggcattttacgtgtgcgcgaagcctgtggctgtcagcctgctgctcaatatcccctttgtggcctactgcctccgggcaagccatctcatgccgggggaatatctggccaatataccggttctgcccattggtatatttgtgctgtccattttccttgcggtgggaaccgcctactggatcggagggaggcggattctgagaggggatctggtcgggatgttgagagatgggacgcagatttgatataaggatgtaaaagcgcgcggacctctggtcctgcgccggatagcagcctgaaaatgaacgcaaatgcaatcacggaccgccggtaatcatcccggcggtccgtgattgttccgtcttataaagtatgtcgtggggcgccttctgtcaccccttaaccggcaaatgcaccagaaagcgcgccccgccgccctcggcgtcctccagcccgatggttccgccgtggagctgcaccagctctttggccacggacagtcccaggccgtagtgctggcggtcggtgcgggagccgtcggcccggtagaagcggtcgaacacgtgctttttgtccgcgtccggcacgccgcagccctggtcggaaacggcaaaggtcactcctgcttttttgtgtccccgggcttcgcggcggcaggcggacagcgtcacctgctttccggcgggggtgtaggtcagggcgttgtccagcaggatggagagcacctgctccaggcgctggccgtcgccggtgaggtggggcagcgcttcctccggaagctccaggcacaggcggatgttccgctcacgggccagcggttcaaaccgctcgtatacgccgatcagcagggtgtccgcgtccaagtcctccctgcggatggtccaggttttggcgtccgcggaggcaagcagcagcaggtcgctgaccaggccggacaaacgcaggcattcccggtcgatgttggccagaaactggtcctgtttttccggggcggcggtcactgcggacaggctggagcggatcacggacaggggggaacgcagctcgtgggaggccgcggcgataaactcgttctgttttttccggctctcctcgatgggctttagagagcgtcccaccagcacgcggcacaccagatacagagcggcgattcccaccgcgtccaaaaacaggaacaggaaacgctgccggtatatccccgcgtccgccggattctgccatgccagcagggtcaggctctgataacccttgggcgccgggatcaccagcacggagccgaagtaggcgtcctggtttggtccgtttaaggtgaagatagaggtgcgcgacagggaggaggagacgggccgcatatcgatgcgcaccttctcctcctccgctttttttatggcctgggcgatcagctcctggcgggcggtgggcggtgtccaggcgcccctgtagagcagaggccgcccgttgtcctcgacgtggataatcagcttgcccgcgctctccatccgggccagccaggtgcagtcgatggtgccgccggactggagccgggaggtgatggtgagcagagtgttctgaaaattttccagattctttttttgaaactcccgtgtgcccaccgccagcacccccaggatcacggcggtgagaatcaagccggtggtcacggtgtagagggcggtcagccgccggtgaagctgtttgatttcattcatgataatccctccagggccgctgagacagcctgcggtcgattacgcggctcacgtctgccgttctttcaactggtatccggttccgtgaatggtgacaatctgcgccgaagcacccacggaccgcagcctgcgcctcaggaaataaatgtagttgtccaggtttccgtcctccacctccgcgtccacgccccatatgtaggtgagaattatttcacggggaagaatctggcccgcacccctgatcagatattccatgagggctgtttcccgcttgctgagacgcactgtacctccggggccggacagttcccttctgtccgcgtccaggcggaggtcggcgaagcatttttctactccggcgtggaaattccctggccggcgggtgaccgcccggatgcgggccagcagctcgcccacggcgtacggcttcaccagatagtcgtccgccccggcgtccagcccgtcgatgcggtcgttgaccccgtccagggcggtggtgatgatcaccggcgtggcgatctgcttcctgcgcagcccctgtaaaatggtcaggccgtccacctggggcagcatccggtccagaacaatcacgtcgtaggggtattgattggcgtaaaaaagggcgtcctgcccctgatagcacacgtcggtctcataacccgcgcgctccagctgcagcttcaccgtgttacagaggtcccggtcgtcctccaccagcagtattttcatggtttttttcctttactgaatagtcgtgtttctttaagtatacgttgtcgtcagccgcaggctgtcgataagagatacgtttctttaattataccagacaaatctctaaaaaacctaaaagaaatatttccatatttccagtttttttagagattgccctgttatgatggagatatacgaaatgacagaaaagggagtggacaatgatgaaaaaacgatggatgtgcgcgctgctggctgccggtatgctggctaatgtcctgtccggctgtggacagtcgtcctttacggagacgcaaggaaccacagatgccggaacgaagcctcaggcccaggagggggattcggtgcctatgggccgctatgtggagggggagatcgagcttccaggggagagccgggaggatatttacgatatcattcaaaatgagagcggttccttggagttgtatacaaaaaaggacggcgagatccgacgctacacctttgagggacaggagtggaagcgggaggagaagagcctgatggagggcctggagattccctataactttcatataattgtgggcggggacggcagccgctacgccctgtatcctctgtccaatggttaccggttccgcctgatgaaactggcggaggacggggagccgcaggagcttttggaggagcttctctccgaaaagcgggataatggctcctacaagcattacccggacttcgcaggcgtgactcccgaggggaatatccttctgtccctgcgcgatatgacgagagtctacacccctgagggggaactcgtcatggaggtgccccagaccagctgttcctcggattggaaaaacgcctcctacttaaaagggaacgagtatctgaccatcggggaaaacgggtatatccgatacgacgtgtccgagaccaaggggcagctgatggaggagatcgcctaccagcaggggaattccgatcagtatgcggccgtggcgccggacaaggacggcggcttttttatggccaaccccaaaggaattcaccacatcggccagggcggaagcatctgggagacggtcgtggacggggagctaaactcgttaagtcagcccagcgcctatatcaccaagctgtttgtgggatcggaggacgatttctacgtgtggatcaacagcgcgggaaccgacatgatcaagcattacacctatgacccggagattccgtccgtgccggggaaaaccctgaccgtgtacggtctggatttgggctcggcggagacggtccgccaggctgcgtccatgttccagctggcccaccctgacgtgcgggtggagctgatcgacggccaaacggaagcggggagcaccacggtttccgataccatccgggcgctgaacacggagctgctgagcggaaacggggccgacgtgctggtgctggacggactgccggcggacgcctatatggagaagggcgtgctcctggatctgcgggaaacgttgaagcctatgctggaagcaaacgagtttggggaaaatatcaccggcccctttacggcggcggacggaggcatttaccggattccggccagaatgaccctgatgaccgtatacggcgacccggaggccctggcgagccttaaaaccatggaggatgtcaggagataccagggcgatccctcccatttgcccctgcggcccaggacgacttatgagaatctgctgcgtcacgtattcatgttgtacagccgggagatcgtggatggtgagagcgggatgctcagacccggaaaggttgcggagctgctggagactgtgaaggtattgggagaggccaacgattccagggaatcctttgacgagtccgatgaaggcgaggtccgtttttactataacacgtccatgcagtcgcagggcctgccgggggacgaatccatagaattgcagcggggcgatatctgcgcggccatagagtctgtggacggaatgtacagcctgatgctgcccctggcggtggccgaccagctgggctgcgagatggaagggtataacgccagctacatgccgtcgcagatgctgggaatcaaccgctccggcggacagatcgggctggcggaggagttcgtccggtttgtgctgggggatcaggtgcaggatagcgacctgatggacggtctgccggtgaacaagaaggctgtggaccactgggccagcgaggactggggaaacccggatctttcgatcgcggtcagcggcggggacggctacagcctggcgggaacgttcccgaccgcagagcaacggcggcatatcttcgccctggcggaggctgcggaccagcccattctggcggaccgggtgctgctcgatatcattatggcggaaacgaagggattttttgatggaaccttgtctttggagcaggcggcgcagaacgccgagagcaaagcgaacctttacttcgcagaatagggcggccttcctgtttcttgcccccagcgcggccgggaccgtggtgtttacgctgatccccttcggcgccgtgatcgcggaggcgtttaccgggatggcggacggaaccttcgcgggattggaaaattttatcctggtggtccacaacgccgccttccggctggcggcgaaaaataccctgcgctttatggcggtgtgcatccctcttctgatggctgtgtccctgtggaccgcggtgctggtgaaggccgcggcggaccgctccggggtgttcaagaccacgatgcttctgcccatggcggtgccggtggcttcagtggtctgcctctggaaggtgatgtttcatcctcaggggctgttaaatcagcttctggggaacacagacggcgcgggcatcgatttcatgcggcagaaaagcgcgttcttggtgctgatatttacctatatctggaaaaataatggctacgacatggtgttgtggctggccggtctggacggaatctcaggggagctttacgaggcggcccaggtggacggagccggggcctggcagaaattccgctacatcacggcgccggggttaaggggcacggcttccctggtggccctgctgtcggtgatcaactccttcaaggtgttccgggaggcgtacctgatcgctggggattacccccacgacagcatctacatgctccagcacctgtttaacaactggttcgtctccctggatatccagaaaatgagcgcggcttcggtgctgctggagacggctgtgctcttcggagttcttctgtggagatggaggagggccggacatgattaaacgggtgatggtgcgggctgtcttgacggttatgtgtctgtttgtctggctcccgctgtttttgatggcgggaaattccctgatgggagagtgggagatgctggaccggtttggagcggtgtttggagcggcgaaccggccggtgaaggcagcgcttcttccctcctatcccacgctaaagccctatgtggagctgttgctggactcgccgggcttttatgtgatgttctggaattcctgcctgcagacgggatttgcggtggccggccagcttctggtggcgcttccggcggcctgggccttcggagccctttcgtttaaaggcaggagagggctgtttctgatctatatcatcctgatgcttcagcccttccaggtgaccatggtgccgaactacctggtgctcaaacggctgagcctgctgaacagccatctggcggtgattctgcccgcggcctggtcggcgtttccggtgttcatcatggcgaagttttttgagacgatcccccggccgcttatggaggctgcgggattggacggggccgggagctggatgattttctggaaaatcggggtgcccatcggaaagccgggcatcgtctcggccatggtgctgggggttctggaaacctggaacgctatcgaacagcccatgacgtttttaaaggagcagaggctttggcccctatccctgtatctgccggagatcacggcggacaaggcggcggtggcctgggccgcttcggtgacggccatgatcctgccggtcagcctgtttgtaatgggacagggggccctggagcaggggattgcggcctcgggaatcaaggaatgagtggtgagcggcgatgaaacggtttacagtgggatttctgattgtgatggtaatatttacatttttatccagggccctggactccgtgaccattgccagggttcagactgggtacgggaagcaggggtccgtgtcctaccggatcacgggggaggggacttttgaggcggaccggctgtcctaccgcccactgccggaggggatgcgggtggacacgattctggcccggcccggggacgtggtacaggcgggggatacgattctcactttgcagatggaaccgctgcaggagaagcgggaggagctggccgtcgcgctcaggcaggcggagctggctctggaacaggagcgcctgtccggccgggagattcccagggtgacccaggagatgctggccctccagcagatggaggtggaccaacgggcgctggagcttggcaggcaggacctggcggacgcccaggaggactacgatcaaaatgtggatgccctccggctggagtacgaccgcctggcaggccgctcggaggatgaaatccgccaggacgccaaggacgcgttaaagagcgccaggcgcgtctacgataccgccaaattggaccgggattctgcggtgaagcgggcggagcgggaggtccgggaaaagcagaaaaagctggaccggctgaacgctcaggaggaaccttcggaggaggcggtggcggacgccgaggaggcgttagccgcggctgaggaggatctggagttggtgaaggaggaacaggacattctggtggaggaagccaaagcgtccctgcggtctgccgaggaggattacgacgaccgcagctacaataccctcaaggcccaggaggactgcaaaaaggcgtacgaggacggcgtgaaggcggaggatgaaaaactggcccaggcccagcggcgggtgctggagctggaggaggtgctgcgccaatccggccagagcctggaaaatgccagaatcacagacgcggggacccgctcggaggaggaaaagacccgggagatttcccgcctgcggcaggaatccatggagctggatctggaacaaaaacggcgcagtctggccaaggtggaggaactcatcagccgggagggcgcggtgacggcggtttcccgggcggtggtggcgggcctggacctgcaggagggcgggctgatcggggctgcggatcagatccggctggccgaggggcggatgctgtttcaggcgcaggtggacaaggaggacgcggcccttctggcgcagggacagcggatgtctttaaaacggatcggggaggccaaagagttaaacgcagtggtggagtcggtggaccgtctgtccgaagacggaaaatgcacggtgagcgcatccattgcagagggcgagggatggctgggcgaaacctgcagcttcacggtggtgctgcaatccggcgtctatcctatggtgatccccattgaagcgctgagggaggatacaatcggttatttctgcctggccgtgcagccggaaaagaccattctgggtgaggaactgacggctgtgcgggtcaatgtggaggtgctggaaaagagcagcacgtcggcggcggtgtcgggcgcggtcaccggcgcgacccctctggttctctcttccaacaaatcggtgtccccgggcgaccgggtacggggggtgacggaatgaaacgatggttgatcatcctattggcggcgggattttgtatcgctgcgatgcttagatggcgggagcttaaggacttcggaagccagatattttacgagtacggggaagcggatgcgccggatggagaactgttcgaccgtatggcggaggcggagcggtcggagggaaaaaccctgccggacatggcggcatggacggtggaggagaacgtggaggtggagaaccggagccttggccgggtgcagaaggccgaccgcatgttggtctggggcgaccgggaactggcggtgaagcgcggcctggaggcgggcaattacggctacccctccgaccccagggcctgcgtgatcagccgcggcctggctatggagctgttcggctcctatgcggtggtgggcatggaggtgcgctgccagggcacggactatctggtgcgcggggttacgcaggacgaccggcgtatggtgattgtgcccgcctccggctcctcggaccggtttccttatgtgttgttggattatggggcggaccggggggacaaatccggggcggaccagctcctgtaccgctacgatgccggaagcgcgcgctaccgggtggacggggagatctgcctggctgttgcgggcttttttgcatttctgccggtgtgggcggccctgggacggtgcctgtttgcgtattttgtccgggagaaacacctcctgcgccggctggccgcagtgtcggcggcagcgatggcagcggcggcctgtatccggattctgggagcggagggaacccgttttccactggacctcatcccctccagatggtcggatttcagcttctggggccagcggtggagggagattgctccggcgctgcgctttgcgggggagaacggccgcgtcttgtggatgacgctgctgcgggagcagacgattgcggggattctgtgcggaaccgcagggggccttacggttatttgcaaccgttcagacggcgggattgtaaggaaaacgttattgacactcagggacaaaatgagtaaagtagggggtaggagtaaatctggatgagcgcgtatcgagtgaggaggatacactttgaaaaagcacagtatgaaacacctgacggcggcagcggcggcggtagccctggcgctattagctgcgtttccggcgtgggcggccagcagtaccaagaagatcacagccattaccctggagatcgaggcggatatcgagccgggaacggatttcggcgaggaatccattgagtttgatgccagtggagacaagttttacgtgggagattatgaggttaagaacgacggccaggcgtgggaggaggacacggttcccaagctggaagtgacgctggaggccaacgacgattaccgtttctccacctccatccgaaaggataagatccgtttaaaaggcgtgggagccgtctgcaagggcgctgcccgcaaggaggcgggacagcagctggtgctgaccatagagctggactccctgacaaagtccttaagacccatcgaaaatgtgcgcctgaaccctgacggggtggtgagctggaatccggtcagcacggccggaagctacgagtttcgcgtataccgggatgggaagtcggtgggaagcgccataaccaccacttacaacagctacaactgttcggagaagctgaccaagagcgccaattactatgtgaaggtgagagccatcaacaaggtggattcctcgattataggggagtgggccgagtccaataccatgaacgtggatgccaatatggcctcttattttaaggacaatcctgtggagaacccggagggcgtgtacccgtacagctcctggaagcaggcggaggacggaagatggtggtatgacaacggggacggaacctaccccagctcaaactggcaggagatcggcggcaagtggtatttcttcgacgcagagggttatatggtgaccggctggatcgactgggagggcaagcgctatttctgcaatgagagcggcgagatgctgaaggactgcatcaccgaggacaattaccgcctgggcgaggacggggcggtgatcagccaggatccggcgccgggcccgtaaagatccggcggtccgcggtttaagctgcggggacgcggggcctgccctgcgggcggccgtcagggccatgagagaatgaacataatacggctgtcgcggacgaatttgtccagcggcagctttttaaaggtggagacaagagaagtggacgattgggaacaacaatttacggatgccctggagatcggatattcctaccagctggcgaaacggatggagcagtttaagacaaaccccgcgctgggctaccgcacggcgggctccaaagcggaatttgagacaggggagatgctcagacgggagatggaggccatcggccttaaggacgtgcacaaggacaaggtgacggtggacgcctgggaatttgagaaggccgagatgcgttttacggattcggagggggtaaggcactgctttcagctgggggcctatcagaccaatttcgacacggagggaaccagggagtttgagatcgtatacctgggcaagggcacggcggactgctatgaccgcgtggatgtggagggaaagctggtgctggtggacatcaaccagcgggacgagtggtggatcaatttcccggtttaccaggcccatctgcggggggcggccgccctggtggcagttcaggagcagggctacggcgaggtccacaacacggcattaaacgcccaggacatcgcgggaccggcggacgcgccggcgttctccatttcccaggcggacgcctgggtgctgaaaaaggctatgatggaggcaggaagctgcccggacgagagcgggatggagccgggcaacatgggcgcggtcgtggtggagttcgaggccaggactaccgtggcgccggaccgggagacgtacaacattgtggggaccataccggggcggggcacggaccggatgattctgctcaccgctcattacgattcctatttcagcggatttcaggacgacaacgcggcggtggcgatgatgtttgggatcgccagggcattgttaaagggcggctacaggccaaagttcaatctggttttctgcgcaatggccgcggaggagtggggggtggcaaactccaagtacgactggtccacgggcgcttacgaggaggtgttcaccgcccatcccgagtggagaggaaagacgttcgccaacttaaatttcgagcttccggcccatgcccacggacagatggacgcagtgcgctgcacctacgagtacgaggatttcctgagccgttttctggagggcgttgaggtggacgagtcggcctaccccgacggggtggaggtgctctgccccatccagacctggtccgacgatttctccatggccgtggccggaattccctccatggtcaacgaattctccggcggagagtttatggaaacccactaccactcccagttcgacaacgacaatgtgtaccaggagccggtttaccgctttcaccacgtgctctacggccgtctggtgatggccttcgaccgcctgctgctgccgcccatgaacttcgagcgcctgatccgggcggtgacagacagcgacgatgtgggaatccggcgcaaggcggaggcggacatctgggagatgaagcgcgccttaaagagggcaaaggaggtctccagagtcttgtaccgcagaatcacggagctgaaccgggattacgctgcgcttcttgcacagggggatacggatgcggcggaccgcatgtttgagcgttacggggacatgcaggaaaggctgctgtacatattccgcaaggagcaggattattttgtgcggctgaactggcacgacgaggtactcttcccgcaggaggcggtgcaggacaacctgcgcgctctctacaaggctctgcggcatgccggggagggaaatgcgcgggcggccctggaggacgtttacggcatcgacaacaatcgatacgcctttctctttgacgagcaggtgttcaactatttcacccagtacgtgttaaaccagcccggcaaccgcttaaaatggggcgcgggccgtatcgtgcaccatgagaacctgtttcagctggtccgcagtctgaagaaaaagctggaggaggggcgggagaaggccgtggatctcacgccggaatacctggagttaaagcgggtgacggaaaatcagaccgcatgctaccgggacgatatccgctatatgacggaatcaatcaaaaaactgaccgcatggatgcaggaatgcctgaccatgtgacgggaggaaatacgagcgatggaaagccgaattttataccgcgtgcaaaaagaggatctgcccaaaatggaagagcttctgacccagtgctttgcccgggacccgctgtactgcaagctgatcccggatgaagagaccaggaagcgcctgctgccggagctgttcaaatgcgacctgtcggagtttttcgagctgtgccagatctactccgacagtccggagttaaactccatcatagtggtgtccgacgagtcggagccctacgatccgtttcgctactacctgaccgaggccctggccgccttaaagacggacgagtacctgatccgggaggaccccagccttaaaaccttctggaactttgtgaggggcaaggactatttaaactctcgctggacagcccagcttcaccaggaagagcgcctgcacatcatctatctggccgtgcggcagggtatgcagcaccacggcctctcggccctgctgctaaacgaggtgatcgcttacgccaagagccgccgcctgatgatctccctggaaacccacaacccgaaaaatgtcccgctgtacgagcatttcggattcaaagtattcggcgtcgtggaaaaacatttcgatctcaagcagtactgcctggtgcgcgaagtgcagtgaggtttgactgcgctggaggcagccgttccggcgggatggcttccgggacacaggacacgcgcccaatgggaaaaccggcggagaaaggcgctttcaggcagacctggcgcggctttccccgccggttttcccgccgtctgggccggttcactataacttctgttcatgataataattccaaacttgtatattccataatcggaaaattcccctgcaacagttgaaatcccccattaaatgagctatgatggaaagaaatcatatttgtttgtttagacataactaaaatgaatgatagaatgggagagatatgaagatgaattataatgtgacagccataccgggggatgggatcggcccggagatcgtgcgcgaggccagaaaagtgctggaccaggtgggcagggtctacggccatagcttccattataccgaggtactcatgggcggctgctccatcgacgcccacggcgttcccctgaccgacgaggctctggagacggcgcgaaacagcgacgcggtgcttttgggagcggtgggcggcaacgtgggcaactccaagtggtacgacgtggccccgaacctgcgccccgaggcaggacttctggctatcagaaagggtctgggactcttcgccaacatccggccggcctacctctacggcgagctggcctgcgcctgccccttaaaggatgagatcatcggggacggcttcgacatggtgatcatgcgggagctcaccggcggcatttacttcggcgaccgctggaccaaagaggtggacggcgtgctgcaggccacggatatccttacatacaatgaaaatgagatccgccgcatcgccgtcaagggcttcgagatcgccatgaagcgccggaaaaaggtgatcagcgtggacaaggccaatgtgctggattcctcacgcctgtggagaaaggtggtggaggaagtggcgaaggactacccggaggtggagctgacccacatgctggtggacaactgcgccatgcagctggtgatgaatccgggccagttcgacgtgatcctgaccgagaacatgttcggcgacatcctgtccgacgaggccagcatgatcacaggctccatcgggatgctctcctcagccagcttaaacgagagcaagttcggcctgtacgagcccagccacggctccgccccggatatcgcgggccttgacctggccaatcccatcgcgaccattctgtccgcggctatgatgctgcgctattcctttgatctggacaaagaggcggacgcggtggagcaggcggtccggcaggtgttaaaagacggttaccgcaccggggacattatgtccgacggttgcgagaaggtggggaccacccgcatgggtgatctcgttgcagagcggatacgatagaggaggagaaacagatgaaaagtgatgcagtgaaaacaggtatgcagcaggcgccccacagatccctgttcaacgcccttggcatgacggcggaagagatgaaaaagcccatggtgggcattgtgagttcctataatgaaattgtacccggacacatgaacctggataagatcgtggaagcggtgaagctgggcgtggccatggcgggcggcaccccggtggtgttcccggccatcgcggtctgcgacggcatcgccatgggccatgtgggcatgaagtattccctggtgacccgggacctgatcgcggattccaccgagtgtatggcattggctcaccagttcgacgcgctggtgatggtgcccaactgcgacaagaacgtgcctggccttctgatggccgcggccagaatcaacgtccccaccgtgttcgtcagcggcggacccatgctggcgggacatgtgaagggccacaagaccagcctttccagcatgttcgaggccgtgggttcctacgcggcgggcaccatgagcgaggaggacgtgcgggagttcgaggagaaggcgtgtcccacctgcggttcctgctccggcatgtacacggccaacagcatgaactgtctgaccgaggtgctgggcatgggccttcggggcaacggcaccatcccggcggtgtactccgagcgcatcaagctggcgaagcacgccggaatgcaggtgatggagatgtaccgccggaatatccgtccccgcgacattatgacaaaagaggcgtttatcaacgctctgaccatggatatggccctgggctgctccaccaacagcatgctccatcttccggccatcgcccacgaggcgggcgtggagctgaacccggatatcgccaatgagatcagcgccaaaacccccaacctgtgccatctggcgcccgcaggccccacctacatagaagatttaaacgaggcgggcggcatttacgccgtgatgaacgagatcagcaagaagggccttctgaacctggactgcatgaccgtaactggaaaaaccgtgggcgaaaatataaggggctgcgccaacaagaacccggacgtgatccgccccgtggagaatccctacagccagaccggcggcatcgccattctgcggggcaacttagcgcccggcagcgcggttgtgaagcgctccgccgttgcgcctgagatgttacagcacgagggtccggccagggtgtttaacagcgaggaggacgccatcgcggccatcaagggcggccggatcgtggcgggcgacgtggtggtgatccgctacgagggacctaagggcggtcccggcatgcgcgagatgctcaatcccacctccgccatcgcgggaatgggcctgggctccacggtggccctgatcaccgacggccggttctccggcgcttccagaggcgcttccatcggccatgtgtgcccggaagcccaggtgggcggacccatcgcactggtggaagagggcgacatcatttccatcgacatcgacaaccacaggctggacgtgaaggtctccgacgaggagctggcggccagaaaggcaggatggagcgcccccacgccccaggtgaccagcggatacctggcaaggtacgcctccctggtgaccagcgcggaccgcggtgcggtgctggaagtgaaataaacccggctgggcggcaaattgacatgcaatagaatgagcgcgcgcctgattccacatttcaggcgcgcttcggaaaaggagtgcgggatatatgagcaaattgacaggagcagagattgtaatacagtgcctgagggagcagggagtggacaccgtgttcggttatccgggcggggccattttgaatatctacgacgcgctgtatcagcatcaggatgagattacccatatcctgacctcccacgagcagggagcgtcccacgctgcggacggatacgccagggctacgggaaaagtgggcgtgtgcctggccacctccggccccggcgccaccaacctggtgaccggcatcgccacggcttatatggattccgtgccggtggttgccatcacctgcaacgtgaccaacagcctgctgggtaaggacagctttcaggagatcgatatcacgggcgtcaccatgcccattaccaaatacaattttatcgtgaaggacgtgaacaagctggcaaaggtcatccgccgtgccttcaccatcgcccagaccggccggcccggcccggtgttagtggatatcaccaaggacgtgaccggcgcggcctgcgactatgagtaccaggcgcccgaggagatcgtgcgccagagcgacaccatcaccgaggaggccatggaccgggccgtagagatgatccgcaaggcccagaagccctttgtctttgtgggcggcggcgctgtgatcgccaacgcttccgacgagctgcgggcctttgcccacaagatccaggccccggtggcagacagcctcatgggcaagggggcgtttgacggcaccgacgagctttacaccggcatggtgggtatgcacggcaccaagaccagcaacttcggcatcaccgaggcggacctgctgatcgtggtgggcgcccgcttctcggaccgggtgacgggcaacgcctccaaattcgctaaaaatgccaaaattttacagttagatgtggacccggctgagatcaacaagaacatccgggtggacgccagcatcatcggagacgtgaaggtgattctgcgcaagctcaacgcccgcttagacccggtgaaccacgacgagtggatcgcccacatcgagcgcatgaaggatatgtatcccctgcgctatgacaagcggcttctgaccggcccctacattgttcaggccatcgacgaggtgacggacgaggacaccatcatcgtcaccgaggtgggccagcaccagatgtgggcggcccagtattacaattaccgcaaacccagaacccttctgacctccggcggcctgggaaccatgggctacggcctgggcgcggccatcggcgcgaagatgggctgcaaggaccgcacggtgatcaacatcgcgggcgacggctgcttccgcatgaacatgaacgagatcgccacggcggtgcgctacaacatcccggtggtggaggttattgtgaacaaccacgtgctgggcatggttcgccagtggcagaccctgttctacggcaagcgctattctcagaccgttttaaacgatgcggtggattttgtgaagctggcggaggccatgggggcgaaagcttaccgggtgacgcagaaggatgatttcatcccggtgctgaaggaggcgatctccctgaatatcccggttctcatcgactgccaggtcagctgcgacgacaaggtattccccatggtatcgcccggagcgcccattgcggatgcttttgacgatacagacttgaaaatcaattaaaaacagtgtatgatagtcagtaacacttcgaggacgttaacacattatcatgttaaagcgtcctcccggcgttaaaggcgatcgtgcgttggcatattcggatgactttcctgcctgcggtccttgaaaccggcccgcatacggggaagtcatctgtatatatttataagagacagatgtacagcaaggccgcggcgcgccactatgcgcaaagccgcggcaaaacaaaccattgaaggaggagcgcgaacatgagcagagtttacaacttttcagcaggtccggccgtgctgccggaggaagtcctggcggaggcgtcggcggagatgctggactacagagggaccgggatgtcagtgatggagatgagccatcgatctaaggcttatcagaccattatcgacgaagctgaatcagatctgcgcgggcttttacatattccggacaattacaaggtgctgttcctacagggcggcgcgtcccagcagtttgccatggttcccatgaacctgatgaaaaacaaggtggcggactacattgtgaccggacagtgggccaagaaggcgtgttccgaaggtaagctgtacggtacggccaacgcggtggcttccagcgcggataagaccttcagctatatcccggactgctccgatctgccgatctcggaggatgcggactacgtgtacatctgtgaaaataataccatttacggcacaaagtataagacattacccaacaccaagggcaagctcctggtggcggaccagtcctcctgctttttgtcggagccggtggacgtgtccaaatacggtctgatctttgccggagcccagaagaacgtgggaccggccgggactgtgatcgtgatcgtcagggaggacctggtgactgaggatgtgcttccgggaacccccaccatgctgcgctacaagacccacgtggatgcaggttccctgtacaacaccccgcccacctacggcatctacatctgcggaaaggtgttcaagtggctgaaagccaagggcggcctggaggccatgaagcagtacaacgaggagaaggcgaaaattctttacgatttcctggatcagagcaagctctttaagggaactgtggtgaagcaggaccgctccctgatgaatgtgccttttgtcaccggcgacgaggagatggacgccctgtttgtgaaggagtccaaggctgcgggcctggagaatttaaagggccaccggaccgtgggcggcatgcgcgccagcatctacaacgcgatgcccatggaaggcgtgaaaaagctggtggaatttatggatgattttgagaccagatacggcaaatagaagcgttttggaaaagaatgggaattacgccccgcaggacgcggggcggttccggtgttgaaagaggagagaagattatgaaaaagatccattgcctgaacaatatttccaagtgcggcacagaccgcctgccccaggactacgtgatgaccgacagcgttggggaggcggagggagttttggtgcgcagcgcgaatatgcatgaaatgcagctgccggagagcctgctggctgtagctagagccggggccggagtcaacaacattcccctggacgcctgcgcccaggagggcatcgtggtgttcaacacccccggagcgaatgccaacggcgtgaaggaaatggtgcttgccggcatgctgatcgcttcccgggatctgatcgggggcatcgagtggtgccggagcaacgcggacgacgagaacattgccaaggccacggagaagagcaagaaagccttcgcaggctgcgagatcaagggcaagaagctgggcgtcatcggtctgggctccatcggagccgaggtggccaacgcggccgcggccctgggcatggaggtctacggctacgacccctacatatccgtgaacgccgcctggatgctgaaccgggatgtgaggcacatcaccagcgtggacaaaatttaccaggagtgcgactatatcaccatccatgtgccgctgctggacgccaccagaggcatgatcaacaaggagaagctggatgagatgaaggagggcgtggtggtgttaaacttcgcccgggacgtgctggtggacgaggacgccatggcccaggcgctggagagcggcaaagttcaccgctacgtgacggacttccccaaccccaagtccgcccacatgaaaaataccatcgtgatcccccacctgggcgcttccacggaggagtccgaggacaactgcgccaagatggcggtgaaggagctggtggattacctggagaacggcaatatcaaaaactccgtcaattatccgaactgcgacatgggcgtatgccaggcggccagccgcgtggcggtgctgcacatgaatatccccaacatgatcggacagatcacaggaattctggcggagcagggagtcaacatctccgacatgaccaacaagagccgggataagtacgcttacaccctgctggatctggaaaatgtgctggagcccatcacgctgcagaagctcaacgccatcaagggtgtgctgcgggtgcgcgtggtgagataggatcacggttcagagcggaggtccggtgcgggacaattattaagacaaaaatcgaatcagagaacgtttgacggcgctttcataccggacggtaccaatgcggacaactgcggacccaggcggttggaggcgctgtcttgcgataacaggaggaaaacagatggcggcagtgaaaccatttttatgcatcagacccaaccgggaggcggcggacaaggtggccgcccttccctacgacgtgtacaaccggaaggaggcgtgcgctgcggtggcgggcaatcccctttcctttttgaacatcgaccgtccggagacgcagtttcccgacgatgtggacacctacgacggccgggtctacgacaaggccagggagctgctggacggccgcatcgcgaacggaacctttgtggaggacctgcaggagtgttactatatctaccgcctgaccatggatggacgcgcccagacggggatcgtggcctgctgttccatcgacgactatgtggacggggtgatcaaaaagcacgagaacacccgcgaggacaaggagatcgaccggatccgccacgtggacacgacaaatgcgcacaccggccccattttcctggcttaccgggccgaccgggcggtgaatcaggtggtggatgaggtgacggcggggaagccgctctacgactttgtctcggaggacggcatcgggcacacggtgtggaaggtggaggacacagcgcagaacgggcgcattgaggcggccttcgcggcgattccggccacctatattgcggacgggcaccaccgggcggcatcggcggtgaaggtggggctgaagcgccgggaggagaatccggggtataccggggaggaacccttcaactatttcctgtccgtgctgttcccggacgagcagctgatgatcctgccctacaaccgggtggtgaaggatttgaacggtttggataaggcggattttctggccgcggcgggggaacattttaccgtggagaaaatggacggcccctatgcgccggatgagaagggcctgttcggaatgtacctgggcgggagctggtataagctggccgccggggcagagtgccgcagctacgacccggtgaaggggctggacgtgtccattcttcaggaccggctgctgggaccggtgcttggcatcggcgatcccaggacggataagcggattgattttatcggcggaatccgggggctgggcgagctggagcgcagggtgaaggaggacatgaccgtggcgttttccatgtacccaacctccattaaggagcttttggccgtggcggacgcggggttactcatgccgcccaagtccacgtggtttgagccgaagcttaggagcgggttgtttattcaccggttggggtaagtttcgatcaatggccgggaagcggtcagggaacattgtgagaaatggcttgaataaacaaggtgcccatcctataatataagcaaataggattgtaggaaatggacttgggggacatgagagaattcaaatatacgatcagggacaagcggggatttcacgcgcagccggcgggattttttgtgcgggaagcgggggcgtttccgtgtgccgtgagggttgtgagagacggaaaaacggcggacggcaagaagatttttgcggtgttgggacttggcgtgaggtgcgggcaggaaattgtcctggaaactgagggggatcaggaagaagaagcgatgatcgctctcagccggtttctgagagaaaatctctgaggcggcgagtgataaggagtagtgaatgaaacataataagcaaaatgagctgcttcggattctttcggaggcctcacagagtataccttcggctgcgcttgccggaatgttaggggtcagcgagagaacgatccgcaattatgtgaaggatttgaacgagagcggggaagcctcgattctggcttcacgggaaggttacaggctgcaggaggtttttggtagccgggaagcggctccttcggaaaatgaggggcgggtctggcagatactgtccgatttgctgaccggcaaggacggggtcaatgccttcgacgaagcggaacgcctttttatcagtgccagcacggtgatcaataccattattccgcaaatcaaaaatgtggtaagagagtatgatctttccattgaatcgaagaattaccagttttacttaagaggaagcgagcagaacaagagacggttgatcgggcatattgcaaccggggatacttatggattttttaacacaaaggaggcgttagagcagcttttcccgcagcaggacgtacacgggattatgcaggagctttacaatatctgtcaggaatccaaaatttatctgaacgactactcgctgaacaatttactgattcacattttgattatcctgatccggctgaattccgatcattgtctgggggagagggaaacttatatttcggccggtgagctgttggaggcactgtatgacaaagaggaaatcatcgcgttggcggatatgatttcttccaattacagggaaaactatggaattcagattccgaaagaagattaccagcagattttgattctgattgcattatcggttgagcatgaggtggtggatatccagagtgtcatcagccatgagtttatttgtaatgtaacctccattttatcgttggtatcagaacgctactgtacgccggaatttgaaaacgattttattcttcagtttgccctgcatgtgtactatgcgtaccagcgctgcacctaccagatcgggtatcccaatcccatcggcccgcagctaaaaaaggattatgcgcctgtttatgatatggccgtttttttcgcccataaattttctaaaatttaccaggtcacatttaatgaagatgagatcgcgtttattgcgttccattttggagcatttcttgaaaacaataagcaaaataaggagcgcatcacctgcgcgattgtggtggaatcctatcactccttttcgaggaagcttgtgaatgatatcagcgcggtatttcatgaacagcttctggtcacggacgtgcttccggtcagccgttttttgcagcaccctccgggcagcgacctgatcatttccacactgccggttgagaccggcggcaggcataccgtgcgggtcaatccgattctgaccaggcagaaccaggacagtatacagaagaaattggatgaaataggagcagagcgggagctgctgcacgcgcgcacgtttctgcggagcctgttccataaagaattgtacttcaggaacgtggcgcaagacagcgcgcaagcatatataaaattcatgggcggacactgtctggaacatggttatgtgaaagaagccttcattcaggatgtgttattgcgggagtcggtttccagcaccgcgtttaccgacaccctggcggtgccccatgcaatcagccaatttgcggaacagtcgtttatctgcgtcgtgcacaacaatatgcccatccgctggaatcataaagcaatccattttattcttttagttgggattacccaggaggaaatgaagtatttcaagtcgtcgttcgatcttatcatcgaactgtttaactctaccagccgaaccatagagctgctcaagacgaacacatttgaagaattttgcgggcgaatgaactgacctgcccgcgagacgatgcctacagtatgcacaacgcccggatggccttaggccgtccgggcgttatgggtattcggaacctgttgccggccggaactgctttggaagaaaacagtgaatttgccggcatcacggcaatcttcttgtattgccgcaatgccggtaagaagtctgttttattttcaggtctgaatgatctaagataaagacagcaagaacaaagcaatctgcaaaaaggagaaaggggaattaacactatgattcgaattttacttgcatgcggaatcggagcttctaccggttttatggccgccaacatgaggaaggccgctaaagcgcagaaactggatgtctcgatccatgcggtcagtaaatctcaggtatcggactatgccgacaaaatcgacgtcctgctgctggggccgcatttctcggctgaggtgccagagtacagggagatgctgaaggagcacaacgtcaaggtcacctccatcgatccggattcatacggcgcgctggacggcgagagtatccttcaggatgccatcgacttttatcatgcgggttaaacggggggatcaggatgaaaaaaattcaggaatggatcgagaagcatctcgttccggttatgaacaaaattactcagaatttctggtttggcattgtggcggacgcgatcctttacatcgtcccgttttccatggtcagcgcgatcccatcgctgtggtcgattctgcggcggtttattccggttctgccggatatctcgccgcttggcaccttctcattcggcctgatcggcctgttcgtgtcctttgtcattccctataactgtctgaacaaaatcgggaaaaaggaccgcgccatgattgccggattcaccggcatcggcacctttatgatgtgcatgaattttgtgacgaccgatgaaggctcgttggtagccatgtcaaaatttggcgcaggcggcatgttcacggcgatgttcgtcggtctgctggtggcggttgtctataaggccatgtttaaattctctttctttggagaggacagcgtgatccctgattttgtaaaaaactggtttgacaatattattgcgattttactcagtctgaccgcgggatacctgcttacctatgtgataaagattgatgttttcacaatggttcagctgatcatgaagccgattaccagctttgcacagagcgggcccggggttgtgctgattgtgttattgcagaatgtcttttatttcttcgggatttccggttgggtgtttacgccggtcacccgcagcatcacccaggcggccattgcggaaaacgcggcaatgatggcggccggtatggctcccaagaacatctatgcctatggatttagccgttatcaccacattggcggacagggcgccacgatgcccctcgcacttttcatgctccgcgccaaatccaaaaaataccgggtgctgggcaaggccactctggtgccctccatttttaacatcaatgaaccgctgcaatacggcgcggtcgtcggcaacccatttatgctgattcccacggttatgattgcgattattttaccggcattttcgtatctgtggtttgtgatgggctggggcaccatcaactatgtcaattttgatatgaattttgcccccaacgcggtttcagccttctttatgtcgggcggagatttccgcaacgtgattctggtctgcattaactttgtgattgccgctctgatctggtatccattctttaaggcggcggacaaggcggaggtccggaaagaagaggcgcgtgcggcggcaaaagcggccaagctcggtgcggtttaagcttaacgatgatgttcaaccattatattacaagaaaggattgtggtgttgtacttccggcaacaccatatggggaaagaaatgaaagatatcaacagcattgccatcgaggtcgttatgaagtccggcgacggacgcgttaagattgacgaagcgctggatgcccttgctctcggcgatcttgcaaaggcggatgcgctgcttaaggaggccggcgatctggtggttcaggcgcataacgcacagaccgaggtaatccagagccaggtgggcggtgaaaacatggaatactcgctgctgttcatccatgcacaagatacgcttatgacgattaacacagaactgcgtatggccaaaaagctgcttccgattgtgaaaatgctgctggccaaaaaggaggcggagtgaacatgacaaaaacatttcctgaaaattttctctggggaggcgctaccgccgcaaaccagatcgagggggcctggaacgaaggcggccgcggcccggcaacctctgattttgcaagattaattactgaggaaatccgcaataccgagggggcgttcgatacccatgtgccgcacaacgctgcatccagggagatggtggccgatatgaaggcgcaccctgagaattgggagctgccgaaacgcagagggattgatttttatcacacctatcaggaagacatccgcctgtttgccgagatgggatttaaggtttttcgaatgagcatctcctggtccaggatttttcccaagggcgacgatccgcagccaaatgaagaagggctgttgttttacgacgccgtgtttgacgagcttaacaagtatgggattgagccgatggtgacgctttcacattttgatactccgctccatctggccgaggtctacaatggctttgccagccgtcatacggttgaggcgtttgtgcgctatgcggaaactgtgatgaaacgctacaagggaaaagtgaaatattggctgacatttaatgagatcaacaacgtgctttcgaatccgtttaccagcagcggcgtcattctgggcggagcgccgcagccgctctcctgtaacccgtatctgggcaactggcagttaaagttccagaccgttcataatcagtttgttgcaagcgctctggctgtaaaaaaattgcatgaaatagacccggaagcaaagatgggaaacatgctatgccgtctggaaaattatgcggagagctgtaaaccggaggatcagcttcaggtgatgttcgaggatcattttaactggttctttaccgatgttcaggccaacggcgaatacccgtattatatgaaacggttttttgacgagaacaacattcacattgaaatgggaccggatgatttaaagattttgaaggatggcgcggttgattttatcacgatcagctattatatgacctatattatgcgatacaaaggctccccggttccgcagcctacaggccgtcttgtctcggatatcaagaatccgtatctgccaaaatccgagtggggatggaccatcgatcccattggactgcgcgttacgctgaaccgtatttatgaccgttaccacaagccgatctttatttcggaaaatggtctgggagcggttgaccattttgacgaaaacggccgtattcaggacgactaccgcatcgattatatgcgcgtccatgtggaacagctgcgcgaagccattgccgacggagtcgatgtgttcggttatgcctggtgggggcccatcgatctgatctcttccggtacatcggagatgacaaagcgttacggaatgatttatgtggatcaggacgactatgggagaggaagcaaaaagcgcagccggaagaaatccttttattattacaaaaagctgatcgcctccaacggagccgatttagaaaatgacgcagtgattgaggtttcatgattgatctgcaaaagaaaagcgtccctgtccaacgcgcgatgggggcgctttttgggttttatgataccggagaatgataaatagcggaaaacagacgtattgcgattcgattccatttttgctataatcatctaatatacgcaaaaatgggattgcacggcagcttttgccggcgtcccgtgttaaatgagaaaggaagtagtctgattggtaaaactgaataacgaagcgctatttaagaacgtccgggcgaatttcgcccacgcgaccctgaactttctgttcatcatcgcctttgtcaacgggtttcaatggatctttggggcggaaaactccatcgtgggggtgatcttcgcgatcatgatgtcggcctccatggtgcgggatatgacggccacgcccgtcaagcatctgctgatccaggccgcggtgctcctgtggatggggatatccgcatttttggtcaatacgctgccgcctctggccgcgtttccggttaatcttttgacggtgtttttcattctctatgcattcacctatgaatattccagccatatgtattttccttacatcttatcctatttgtttttgatctttatctctccggtgacggccgaggggcttcccaaacggctgctgggactgtttgcgggcgcggtgtgcgtgatcctctatcagctgtttatggggcgcaggcgggcggctgaaacggcccgggatgtactctgctccatggcggacgaggccgtggacgcgattacataccttctgaccggccagggggaggcggctgacccggagaaggtgcaccgcaggctgttcgggctgagccagacggtgtacgaccggagaaaaaaggctctctgcgtttcggacgccgggttctccatgatcgacgccgggcgggggctggagcatattgtgcttttgctggtggacctgaaggagccgcttacccctgagatgaggaaaatactggaaaaaaccagggagaagatcggggagtacagggcttatatctcccaggagggcgggcagcttgcgccgccggtgcgggaagattttgcctgcggcggggatgagggggcggagacggatttttacaatgcgctgctgtacctgcacaatcacctgctccatctgtccgatccccagaagcgcacccattaccgcaagaccgtgctctccgtgtccgtgcggctgaaggcggcgctggacgtcagccccgtgcgggttttgtacgcgctgcgggtggcctttcttttgtccgtattcaccctggcggtgcaggttctggccctgcctcacgggaaatggctgctgttcaccctggcttccctgtccgtgccctacgccgacgacgtgaagcggaaaaccgggaagcggctaatcgccacggtggccggcggattgttcgctgtggcgctgtactcggtgatcccgtccatggcggggcggacggcggtcatgatgatctcgggctacctgtccttttactgcgccgaatacacgggaacctttacctgttccaccgtgggcgcgctgggcggggctgtgtttatgaccgctttcggttggtccgatgtgggagccatggcgattgtgcggcttggttatgtctgtgtgggcgcggcgctggccgtggcggccaactgcctgctgttcccctaccggcgcaggaccgccacccggcagctgtttaaaaagtatgcggccaccacggagctgctgacaagggtctgccgcgaatgtcaggtggacacccagctctactacagccttgtgatccaggcccatctgttggaggccaagctgctgcagaacgccagggcggcgggctgggatgggctggatgagattctggtcaggtgcagggccgcggtgcggcgcgcacacaggagccggacggcggcggtcggatggtagatgtgaaggttttcggactgcatttccccaaaatcagtgacaaacgtcacgctcattcatgacgtatggtatctgtcccccacatcgcgtctctgctataatgtggacaacaaagagagaaaagcttgatccggttgataacggaccggaatagggggaagaaacatggataaaaaaatattgctggtccatccggaagtgtccagaaacaagtataattttaacgggattttggaaaatgagccgctggagcttgagtacctgagcgcggtcttaaagcaggagggatatgccccggaaatctttgacgtgcccagagaagcggtttctctggaggagaagctgcggcagtaccggccggatgtgttttatatctgcggccggatcaagcaggaagcgtttatgaaagagtatatccgcctggcgaagaggctgaacccgcaggtcgtcacaatcgtaggcggactccatgtgcagaagaattatgagcggttttatatgcccgagaccgattatatcctgaccacgtttgacgtctttcagatccccggaatcattgagggggaggcgctggaggagattccggggctctgttacagggagggcggacggtggaaatgccaggcggcgcagccctttgacatccgccgtttgccctggccggaccgcagttacttttactcccatccgggacattacaactattttgagattccccactgcgcccaggtgaggaccgcttactcctgcgcgtttcgctgccggttctgctatcggaacgtgctcaactgcgggacctatacagcccgggacattgaggatgtggtggaggagatcgcttccatcgacagcgagggaatctatatcattgacgacgactttctgctggacgcgaagcggatccgccggtttatagacctgatcaaagaaaagggaatccataaaacctatgtctgcatgggacgggtggattttattctgaagaaccgccagctgatccgcgactttgccgaaatcggcctgctgtacctgatcgtgggcctggaggcggtggaggacgcctacttaaaacagtacgacaagcggacgaagatatcctggaacgcggaatgcgtgcgttttacaaacgagctggggatcaagatattcggcatgtttatcgtggacctggatttccaaaaaaaggatttcgaccgtctgtacacctggatcgccacgcggggcgtgaataatgtggccgtctccatttttacaccggtgccgggaacggaaatttaccgcgattatgcggacaagctgatcacggacgatccgggacactgggattatatgcatctggtgtgcaggccggagaaattgtccgtccggaagtattatttttattattatgtgctgctgatccggttattcctgctggcgaggaggcggggagtgtatgacggtatcgactaccagtcctacatcctgtcgtttctcaaaaatatggtcagagggaaaggcgcttgatgacggtggaaagggggaaatgcggaatggcggacaggcggcaggatccctgcgtatacatctgttttatggccacaatgaccacgattgcgaagatcagccgccgcatttccggctgtgactacacccatatttccattgcctttgacgggaagctggaggactttgtgagtttttccagaagaagcgccaacacgcctctggatgccgggatcgtgtgggagcggaggggagattatgtgcagccggggcagacttcttaccggacaaagatttatcggataccggtcggccggaatgacctggagcggatcaaggagctgatccgggattatgagcgcgacccggaatatatgtttaatattttcagtatggtgaccatgacggtatttcatggattttcaatctataaaacggaaaattgtatgtcttttgtgggaagaatcatagagatgaccggcgctgtcccattttcaaagccctgttataagtacctgccggaggaatttatggcgcttctgggccggtatgaatattttgacgggatgatgccggcggacagcgcggacaaaaaacacagggagagaaggattggtttctggcggaaatccgtgttaaatgccggaatccttctgacacttttgtatcgtatggtctttaaggccgggaaaggcagcaggttaaaggatggagacgaaaatcaccatagcggcggatgtgaacggggatattccgggagggctggcggatgaatacgggattgtcattctgccccagtattaccggtttgatcgggatgacacagtgtatggagacgaacagaatttaagctccgcagagtttttcgcgcgtttgtccggaggggagagggcctattccatgggctgtaacccgcagcgggtcagggaattgctggagccgcggctggcggccggggaggatatcatctgccttatgttttcttccgctttgagcggcagctataacacggtctccctggtggcgcggcagctctgcggggaatatccggagagacggatcaaggtgatcgataccttaaacgcctcctttgcccaggggcttttagcataccgcgcggccaaacgccgcctggaaggctgttcttttgatgagatcgttcaggcggtggagtcggagattccccttgcaaatctatggtttgcggtcaacgacttaaaatatctggcctggggcggcaggcttgggggcgtaagcgcctgcatcggaacggtccttgatatcaagccggttctgaccgtcaatgaagcagggcagatcgtggcgaggaataaggtgcgcaccctcaggaaggcggtagcgtttatgacggaccttctgcgggaaaaacagggcggatatccggagctgggaattgtccactcgggctgtgaggccctggcgggccagctgcgggagcggatattagaggaaaagccggaaggggttgaggagatcatcgtgtcggagatcaaccctacaatcggggcccatattggaccggatgcggtgggggtggtgtttttgcagaggccggatgtgaacgttatggaacgggatgcggcggagcagtctgaaattcactgcaatcaggcgcgctatcttgcagggggagtttaaaccgctaggcaaattttcgtttctatggtaggatataagagaactggcgtcggataaaccactgccgttcaggaggccatagagggggatatcatgagattggggaaacaaatccgccgtgtagacgtacaggtgtcgattctgatgattatcgttaccatattctgctccacctgtatttatctcgtctgttaccggatgactcaccgggatatgatcaacagcctggaagagcgggtgttcgcaatatacgattttctggaggactccctggacaaaaacatgttcgaggagatcaacacccgggaggacatggagaagaaatcctaccgggagatgaagcggctgctcaggcaggtcaagagcgccaccaatatgatgtatctgtatacggccaagaagaatgaggaagggcagttcgtctacgtgatcgacggcctggaggcgcaggcggaggatttccggtatccgggagacctgatcgagccggagatcgtgccggacatgcagcgggccctggacggtgagcgggttctgccaaagaacatcaaggacacggaatggggaaaaattttcatcacgtatttcccggtgcacgacggggagaaagtggtgggcgtgctgggcatcgagatcggagcggagcaccagtacaacacctaccagagcattttgcgggtgcttccgggcatcgtgctgtttgtcagcctgctgtccacagcggtggcggtagtggccttccgaaggatttccaatcccacttaccaggacctgtacaatacggaccagctgacgcagttgaaaaacaggaacgcgttccagacggatttgagcaacatggaggcggaggggatccgcgcgggagtgggtatgatctccatcgatttaaacgacctgaaactggtcaacgaccggtttggccattacatgggagaccggtatatcgagagcgccgcccgggcgatccgggccgtggtgggaaaacggggagcggcctaccggatgggcggggacgaatttatgattctgtttaacggcgtttccgaggtggagctggaacagattctggacggaatctgccggtattttgcccagcgggcctccgaggccggcgcggatgttccgctgtcgctgtccggcggcgttgcggtttacgacaaggcaagggatcgtggactgacggcgctgtatgagcgggcggatgcgtctatgtatgagagtaagcggttgtaccatacggaacgggagaaacgaaggagcggctgagataaaacatgaaaagccccgacggccctggggaggggcggtcggggctttttttgtgcagtgagctgcagatgcagcctggaggagatggttttagcgctgagatagttccgggctttacaaaagtttatccagctccgcatttaaacgcgttttcaaatcctccaattcttccgggcagggcatatattcctttgcatacagttggtctccaagctgccagaccggtcctttttggggcgtgtctccgcttcgtctgggaaagatatgccaatgcatgtgaacgcctttccctgcgccgagaagttcataattcagtttttccggctgaaaggcgtgataaaccgcctctgccaccaccgacatttcatgcagaaattcatctctgaattccggcgcaagaaaatgcagctcggtctcgtgctgtttgcataaaaacagcgtatatccggtgaaacgctggcagtctcccatcacgacatagccggtattcaattctcttacaaaatatgggtttttgccgctcttgatccggtcaattcgctcgcaaaccatgcaatcgcacatgtatatccctccgtaaactccaaatttaccctattatatcaaattatgtctgagaaatgaagtccaaccggtctctccaactcctccgtctccgaattaaagtccccggtcaaccggttctcgatcaccagaaccagggaacccggcgcgatggtccgtgcgtgccaggttccgcggcggatgttgtagagcctgagcggttccatttccacaggcgtgatgtctgcggagttatccccgtttccgcctgcaaaaatggtgcaggagccctttaacagcacgaaaacctcgtccgtctccatatgccgggacatggcggtagtcgggccgccgcttccgtttccggaggctgccgcaacccgccagtccccgaactggaccaggggctgaaagctttttcctgcgctcttgtcgtactcgtaaatgtcaattccgtttgtctctgatagcttcatgtgatccccccctatatcataaaaccgatcataaaatcccccacaataaatgtcaatattaagcaaagaaatgatacttttttaaaagcaggcgcaataaggtgatacttttttgaatttggaggttgttgtgtgaagattttgccaatgatacaatagagttacaaaaaaagtcacgaccaaatcagagagggaggttatcatgagaaaacacaaacgattgatcgcagcgtttatggcggcaggtatgctggcggggagcctggccgggtgctccggctccggaaagacggcggagcccaccacggcggcgggggctgagaacaccacagcggcggcccagacggagggggagaagcccggccaggcgtccggagagacggttacactgagaatgtcctggtggggcggggactccagacatgagcggattctggctgtgatcgacgcgttccagaaggctaacccagacatcgtcattgaaccggagtattcggcatttgcggactaccgcgataagttcaccatgcagctcacgtccggcgcggctgcggatatcatggccgtggaccagccctgggtgtccagcatcatggcgcagggagatttctttgcggatttaagcggttacgccgatctgggactggacgatatggacgcctacattattgacaatttctgtaagttcgacaacggaaccttctttgtcccggcgggcgtgaatggaatgggttccctggtggacacggagaagctggcggagtacggcttcgatcccgccgacaagacctttacctgggacgacctgatcgctctgggcgagaaggtgcacgcggcggattccagccagtacctttgctgcgtggacagcaagcaggccgccctgtactacgccagagtttacctgcgccagctgaccggcaagcagttcatcaacgacgacggcactgtgggcgtgaccagggaagagctggccgaggccttgggactggtgaacaccctgttcgagaaggggattttccagcccatcgaggaggcaggaatctatgagaactccatgacccagaaccccacctggctgaaccgtcagatgttcatgattctgggcagaacctccgttatgacggacgcctccgccagacgggccgacgagagcggcaattacaccacctccggctatgtgctgccccagatggagaacagcaaggaatccggcatcgaggtccgtcccaccaccttgtttgcggtgaacggaaagtgtgaaaatccggaggcggccgctaagttcctgagctttatgttcaactccgaggagggagccgagctcttgaaggacacctactccgtgcccgccagagagagccttcgcgccttctgtgaggagaaagcgcttttggacgagtccgccatggagaacgtggtatattccctggaaaattccggaaacgtggtgaacgcgtggtccaacaactccgaggtggaggccatgatgacggaaatcatgcagaaaatcgcgtacaaacagtatggatctatggaagaggccgcggacgaggtgatcagccgcatcgaccagatcgtcgcttcctcggcacagtcctgacagagttgccggatgcgggtttgagtgatccggcataagcattaacaggtttccgatgttcctgacaaaaacatcgttttttaatgaatgtaatgggccgcaggcgcagcctgcgggcgattacagaatggaattaacgccggattgcctcagggattgctcccagtttaagtccggggaatggaggaactatgatttcgaacaagatgaaatccaaacggtatgtaggacttctctacatcgctccgtggctgctgggttttctgatcttccagctgtatccgtttatcgcatccctctgctattcgtttacggattatacgctgttaaaccagccgcagtttgtggggctgaaaaattatctgacgctgtttaccacggacaaacaattcctgtccaccatgaagatcaccggcttctacgcgctgctttccgtgccgctgaagctggccttcgcactgttcatcgcgatcctgctgaacgccaaaatcaaagggatcggcatttaccgcagcctgtattatctgccgtccattctgggcggaagcgtggccgtgtccgtgctctggcgggtgatcttcatgaaggacgggatgatcaaccattttatcggactcctgggcctggggccggtgaactggttgacggacgccaagctggcgctgatcaccctgagcctcttgcaggtgtggcagttcggttcggccatggtcattttcctggccgcgctgaaagggattccggcggagctctacgaggcggcttccattgacgggagcgggaaatggaaccagtttctgcatatcacgctgccgcagatcagctccgtggtatttttcaatctgatcatgcagtccatccaggcgctgcagaacttcacctcggcgtttgtgatcacgggcggcgggcccatgaagcggacttacataatcggcatgaagctgtacgacgacgcgttccggttctacaaggtgggttacgcctgcgcggagtcctggatcctgttcctggtgattctggcgctgacgcttctggtattcaaatcgtcggacgcctgggtttattatgcggatgaaggggggagcaaaaaatgatggataaggcttccagggcggcgctgatccgccatctgatcctgattgtggtgggcgttgttctgatctacccggtggtatttatggtgttcgcctcattcaaggacaccaatgaaattttcacctccaccaagctgctgccaaagctgtggcacggggagaactataccaacggctggaagagcggggccaccggcgtggtgacatttaccaattttttcctaaacacctttaagctggtgattccggtggtggccttcacggtggtttcctgcacgctgacggcctacgggttcgcgcggttcgacttcccgggcaagaaaatcctgtttccggtgctgatctccacgctgatgctgcccaacacggtgatcattattccgcggttcatgctgtttaaaaacctgggctggctggacagctacctgccgtttctggtaccggcgctgttcgccgtctacccgtttttcatttttatgatcattcagtttctgcggaacgtgccgtccaccctggacgagtcggcaaagatcgacggctgcagttccttccagatcctgatccacatcctggtgccgctgctaaagcccgcgctgttctcggccggactgttccagtttttgtggacgtggaatgatttttacaaccagtttattttcatcaattcgccgaaaaaatttactttgtcgctggggctgcggttgtccatcgacgcgtccacggaggcggtgaagtggaacgaggtcatggccatgtcggtctgctccattattccgctgtttatcctgttcttctgcgcgcagaagtatttcgtggatgggatcgccacatccggaatcaagggttagggggagattattatgaaaaatgagggaatattgttttatctgtcgggagagcaggggagcgtgccggagattgcggcaggcaacccggaacccaacttttttaaggatgtggaagtgatcggggacgggcggaaggggaaggcgctgcgctgcctgcccactcagcttctggcctactgggcgccgggcaacctgtattcccagagagggaccgtgtcctttttctggcgtagcaggacgcccctggggccgacggaatttccgctgtttcgggtgtcctttgcggatcattccagctgggacgcgctgtttatgcgaatcgattacaacgggcacggcatcgacgcttttgtgacggacatcaacctgagccgtctgcgggtatcccaccggtttgaggcgctgccggagccggatcagtggttccacgtggccttttcctgggacgagaccgtgggcgtgcggctctatatcgacggggagctggcggcaaagctggatcgggaggcgctcttatacgcagggctggaccagttcggcacccactcccgggtgatcagcaacgcccaggtgcagtccagctacaattacatgcgcaccggggactttgacgagatcacggtgttcgaccgcatgctgacggacggggaagtgcgggcggtgagccgtctggagatgcctgcgcttgcaaagcttccggcgcgggatctgagggaggagcgttggaaccgggagtggcagaggcgctttggcttcgacgccggagaaatgcccgcggcgctgacccatccggccacggcggtccgtaaggtggagattcacgacgcctgggatcacaagcgctggtggtggaagggctgcgacggaatccgggagaccacctggccgggcgtctataaccggtccgggctgccgggcagaaccgattattttgtgctgccggactgggactgctattctgtctccggtaaggagattacgttccagccggtaaaggacgcatatttcaaccacatcgagatttccggctccgccgcgggccagctgcggattcacgggcgcatggaggagcagctgaaggtgcgccgggagtcctgcgagcgcagcgtgctccggctggcggaaccggtgcggaatgtggacatcaccttcaccaacgacgtgatcgaggagccaatcggggatatcaccctgctccaggtggagcctggcgtggctccggagggcgcggccagggaaatgttccggttcgcgccggacgacgggaaaatggggccggaatgctttgacggggtcagggcgtttgtggccgggagatttgcggcggatgagaggcggtgctttgcgggggatttggcgagcggttcctcggaggtcccggcgaacggctcagcggaggttccggcgagcggctccgcggaggtcccggcgagcggccccgcagaggttccggcgagcggccccgcggaggttccggcgagcggccccgcgggctatgttctccccgactccccgctcctcccgccgtcccaagccctccccatagcccactacatgctcccttaccatcagccggccggcgccggcatggacggtcttttgcttcacctcccgcccctcaactgcgcgccggatcacggccggtacgtgctggtcaatgttcaggtgaaggacccgctgtggatttaccggaacctgataaacttcaccttcgccgttctccccggcgccgccaaggaaatctggctggacaccagggaccgcatcctgcccgaagggaacgccctgtacgtgcagatcgcctggtcaacccagatttcttcggaatatatggaaaatatttccatggaagtgatctacaaaccctgcgaagaagcgaagaaagagcacatagaagaccgctggatccaggtaaaggacaattacgcaaacctggtggaggaaaatccctccaacgagcatttcaatttgttcaaccggtttaaggccgacctgaccgatctgctgcgggtgtgcccggatcaccgtctggcccgggaatactggtacgataaattcaaaaccaatccgccggaatctgccttctcccgctgccccgagggcatcccgctctgggcctggcggcagacagagtacatggggtacgtgaaacgctacatccgctggtggatcgacaagcgtcagatcgaaaacggcgagttcggcggcggcctttccgacgacggcgacctgacggcctggtggccggggccggctatggcgggctgcatgccggagaagatcggggactccctggcccgggagatggaggcattttacgaccagggtatgttcgctaacggactgtgcgccatccagacggaccagcttcacaccctggaggagggaatccagtgtctgggccagtgcctgactctgttcccgggctctcccaaatacatggagcgggccatggaaaatgccaggggcctgcactatgtgaccggctacaatgagaagggccaccgccacgtgctgtcgggctactattccggcacccgcattgcccgggaagcgccctgggattactccgcgtcggattccttccacgtgttccaccccacctacatgctggtgcgctacaacggttccccggaggcgcgcaggctggtgctggagatggcggattccatgctggagcactactacgacgggcggctccacgtgctggtcaacgtgaccacggacgaggaccaggttcacgaacggaccagggaatggcccctattctacgcggcgtggaaattcaccggggatgaaaaatacttaaagcccatcgatcccgccctctacgagcagcagcaggaccgtttcccgggaacggatatcggggaggccgcggcaaagcgctacgaggttattctgcgcaaggccgcgctgcgggaatacatcaatacggacggtcagctgtgggtggaccggggcgtcatcgacatcgcggtgatgcagcaggaccgcataggcggcgtgggacacgagcgtttttccctgtacccgcggcactacttccgctggcagtttaaaccttcccaggaaatggacgtggccgtcatggtaacgtacgcggccccggacaaaatacgcctctccgccttcaacatgaccgacgacgacatcaccgcccacatgattatggaagatatcattcccggaaaatggacggtgaaggccggcacagggccggagatcggcgtgatggaacagtcagaggaacgggaaatggaactggagtggatgggcggtctgccggtggtgtttaaacccggccgccataccgttctggagctggacctcagggagcgggaaaacggatactgggagcgcccggacctggccatggaccgggaggacgtgatcatccgggacgactgcatccgcgtgcgggtgcacaacatcggggccgcagagagcgcggagacggagctggtgctcaagagtccctccggcgaaatcctgcgccgcagccaggttccgcccattcctgcgccaaacgacctgtatcccaaggtgatggaaattcctctctggaccaggggaatcgacctggcgggctgctcggtggagctggatcctgaaaaccggatgaaggagattacaaagaccaacaaccggatcgtattgcagggaggtgctctatgaagttgagttataccacactgtccgtccaggacaggaccatcggggaggcggtggagatcgcgtcggcccacggcctggagggaatcgagctccggggccggggcgacgcccacgtgtcgcctgagagtacattttcctatgccgctcacgtgagagaactggtgcgggaacataaactggcggtgccctgcctgaccgcctacacccggttccaccagcccacggcggccgcggtccgggaggaagtggaccgcatgatggacatggtacggctggcggaatttctggaagcgccatgcctgagagtgtttatggggccggtaccggatctgccctcggagactctgggcccggcgccggatttgtcctcggggcccctgatcccggcccaagcttcgttaaacctctcgcaagccgaccaaatagccatagaaggtctgcagtacgcctcaaaacgcctggaaaattcccccgtccggctggtcatcgagacccacgattcagccaaggacggaagaaccctggcgcggctattaaaggacgtgccgtccaacatcggcgtgctccttgacatcatccacccctgggacatgggggaagagattggaaaaacctgggaaatgattggggagcgaatctaccatgtccacatcaaggacatcagccgcactttggaaaacggccgcatttactgtcccatcgggcaggggatcctcccggtggagtccacggtgcgttggctggaaggccggggatatcagggattttactccctggaatgggagaagtcggccctggaaggccagggcgtgggattcgaggaacaacttgatagctttgtatcatttatgaggggagtggaacagaatgggaacagtcagattaccctttgaggaagtgaaggcctgtctctgccaggtattggcggggcggggctgcccggagaaaaaggcggagaaggtggcccacgagatggcgagaaactcgctggagggcgtgtacacccacggcatcaaccggttcgcgcggctgatccgcaatattgacgaggggatcgtaaggcccggggcagagccggaggtgacggtgcgcatgggggcgatggagcaggtggacggccatctgggccttggcatcaccaacgcctggttctccatggaagaggccgtcaagctggccaaatcctacggcatcggcctggtggccctgcggaacaccaaccactggatgcgggcggccacctacggctatcaggcctgcgacgcgggtatggcggccgtctgtttcaccaacaccatgcccaacatgcccacctggggggcggtggactcccggatcggcaacaacccgctggtgtttgcatttccacgcagagaggggcacctgatcacggacatggccatgtcccagttctcctacggagcgttggagctggcccgtctccaggggcggcagatggcaatcgacgccggctttgacaccgcgggcaatctgacccgggacccggacagcgtgatcaaatcccaacggattctgcccaccggatactggaagggggcggccctgtcctttatgctggacattttcgcgggcgtgctgtccgacggcaacacagtctcggaggtaggcagactgtctggggatgagcacggggtatcccaggtgtttatcgcggtggattaccggaacctggtgacgcaggaggcggcggagcgcatcgtggagggcgcggtcaaagatctgttggcctccgggaaggcccaaggcacggaccggattatctacaccggccagctgaccctggaatgccgggcggacaacttaaaaaacggcattccggtggatgagggcgtgtggaacgagatttcatccctcctgtgattcggcggaggtgttgatacaaattgtgacggaaaagcctttttccagctggctgtccagggtaatgcggcattggtctgcggtaaatctcaactgcaatctgcggaagagattctgcaggccaatgtgtttttcgtggaagccctcgaagctggaaagggaattccgcagctcttcaaggcgcccggggctgacgccgttgccattatcccgcacctggatggtgagaagttcgtcccggacggagatgtcgataaagatgtccaggggatttgtctggctgttgttgccgtgggtgacggagttctcgatcatgggctggaggatcagcttgggaatccggtagctctgggcctccgggtccacgtcccagtgcacctggacctgtcccgcgtagcggtgcgccatcagtgccgtgtagtgggtggtggcctcgatctcctgctcgatggtcacgtcctcgtccggcgccctcaggctgtattgcaggaaaatggacaggtcctggatcatctcgttggccgtggtgggcagcttggtgtgctttaagatctcaaaatcgatcatctgcagggtgttggagagaaaatgggggttgatctggtattgcagcgcggacagctccagggacagggcctggaacttctgttcgtttaaggacacctctaaaaagtcgttgcgggtgaaggtctggatcatattggttacaatgtggctgtacaggtcgttgctgtggggccgtatttccggcagctccttgtgggagatggcggcgtccatcaggtccaggatggcgtagagctggcgggacatgttgacggcgtaacggtaggaggtcatgacggcgaccaggatgcagagaaacacggtggcgcaggtgatcccgatcagccggtaaatattggcgtaggccagggagaccggcgtgacggagatgaaatccagccccgtgttgggggagtaggagcgcatgatcagattgttatccaggcgtagcagtccgccggtgtccgtcatgccctccaggcggcccaccaggtcctgggcgtccagatcctggctgctggagaacagggccttgccgccttcggccaggacgatagcccgtccgctttctaagtaggagttggtgaacaggcgcttgaaataggagaccacgatgttgaccgccacggtgtagcctttggaattctcctggactacggtcaggtagtcccgcggggcggaggcgtagaggctggtgctgcggcggatgacccggtaggcgctgtcgccggaacaggcggaaagccagtccttgtccggaccggaggccatctcgtagacattggcctggttggtcaggtagcggccccgggcgttgggaatgtagacgtaaatgctgtcgatgtagtcccgggagttgacgatggcgtttaactgcgccgccacctgttttaagatcacaaagtccacgtagcccagcttttccgactggaggatctggtagatggagttggaattggagtaggccgggacggccagcatattcatgaccttgttggaatcgttcagcagaaggtccacattttcctggagcagcgagaggttgatttccgcctcgctctccagggattttttttccgtgggcaccaggacggcgaaaaagatgacagtgagaaagagcatgggaagcagcgacagcgtcagcatgcggaccatattttcggcgaaaaagcggcggcgcataggggtaaatcctccttggggagtagtcagcgtttggccggacaggggtcaacgccgtggtactgtttgaacacgcgggaaaagttccgggggttgttgtagcccaccatccaggccgtatccgatacggaacgcccctccttcagaagctgcatggccttttccatccgcgtctggttcaggtagtcggagaaggtctggttcaggcagcggtggaagatggtggagacgtagctggcggacaggccggtcagctcggcggccccgatcagggaggcggtgtccgcgttgtcccggacgtactcctggatgcgggtcacgatctcgttgtaatagcccttgtaggacacgggctggccgtcgcccgtggtttccggcgcggggccgggagcgctttccgggggaatggcggaatgggtcaccgtccggaaggttttcatcagttccccgtaattcaccggctttgtcaggtaggcgctgaccccgaagcgcaaagcggtgcgggcgtactcgaagtccgcgaaggcggacagcagaatgacgggaacctccgggtacgtccgccggacggcctgagtcagctccagcccgtccatcaccggcattcggatgtccgcaaggagcaggtccaccgggttcatttccatgtagtccagcacttcccggccgttggcggccagaaaaaccacctgaattcccagttcttcccaggggaagagctggcttaagctgtcgcggatattgggttcgtcgtccgcaatcaccagtttcatatatgagctcatcgttctgtatcacctcaatgtcaggtttctccctttttccggtactgcatgggagtcatgtggtagtagttgtggaacgcccgggaaaaattcttggaattggtgtagccggtccgggcggcgatctcgccgatgctgaggtggatatcgcgcagcagcccggcggcccagatcattttctcctggcacacgaactccgggaaggtcatggacaggcgctcctttaaaagcccggagatggagtcgctgccaaggccggtggcgcgggaggcgaagtccaggctgatttcgccgggatgttcacggatgcaggcggagagggcggccagcgccggctcctccttattttccggcgcaggggacgtttcacgggccgcggcttcgatggaatctttcaggcgggtgaacagatcgaccagttcctggtagcggaccggcttgaccaggtaatcgtcggcgccgtagaggatgccctttctggcgtactcgaaatccgagtaggcggacagaaaaaccagccgtgccgggatattctgctcgcggatacagcgggccagctcaaggccgtccatgaccggcatctggatgtcggtcagcaccacgtccgcgggattgtgttccaggtatgccagggcctcccggccgttggcaaagacggaggccacctcatagcccagctcctcccatgggaagagatgcgccaggttgtcccgcatgaacgattcgtcgtctacgatgattaagcgcagcggctggggcatgacttgcctcctttcagtgtggggaaatggtgggcgggtgtctgaatttaattatagcaaatggggtgggagaagtcaaaaaaacagccgcatctgcgaggaaatcgcgaatgcggcctttaaaaaatatcttcggaaagtctggtgttgccccgcctgggatacatctctagggattactctccggcgctttcggcggttctgcgggcggcgtatccggtacctgcgggtccttggtgccgtagacccgggtccattccttggtgccctccacctttacagcctggctgcggttcatggacaggaatttgaccagctcgtagcagctcacccagatctcgttgttgccctccttctgggactcgtcgaagatcagctggaggccgaagtgaagatggggctcgtcgatgttgttggtgttctcggtgcggctgtagccggtgcggcccaggtagccgatcacatccccggcctggacgtagctgccctccttcaaattggactggtaggggtaatccttgcgcagatgagcgtagtagtagtaccgtttcttgtcaaagctgcggattcccagcctccagccgccgtactggttccagcccatggcctccacgtagccggattccacggcgatcacaggggttcccacctgccccatgaggtcgtggcccagatgctggcggcggaagccgtagctcctggctacgccgaagtcgtcgaaatcattgtaaggaaagcccttggcgataggggaaaatgccttcagcccgtatttggtgacccagatggtttccgggtcgccgggggccccgccggtgacgccggagggcagataagcgcccggggcttcgctggcgggaatctgcgcctcaaactggcccaccattccgtccagcaccgcgccgtaggcctcccggtaatacctgtagtatttcatgtccttggtcagcgcttccatggtggtctcgccgctctttaatttttccgccacctgggtcatgtccgcggctttgtagcgggagaagtcgcctccgtagcgcgcgcccagataggccagaagatccacccagttcaagtggacgtccgcctggcaggtgtccacgtcgtagcggaaggcctggttcatggcctcgcaggtcacggtgaaatccacccattttatgtaagattttgcctcgggcggggtggcattttcctgtttctggggaagcattttttccagccccagggcggcggccgccttacccgcgtgggccatggcagcctgccccggctctgtgcgaaagagaaaaaatgagaggcacagcaggctcaacaccaccgattccgtaaatatgatggtcttttcgctgatcggacggcgggtccgcagacgttttgctcggtctttccaccacatagattgattacctccttcagttccggggcggagccgggcgcattttggtagacgcgcgatgccgcggcgtgggacacccgtttatggttatcttatgcgtgggaatggttgtttagacctggggagaaggggaaggtgaaaatttagggacggcagcgtgtggcttgggccaggggagcgggccgggcgagaataacgggagcggggcaggcgagaacggcgtggcgtggaccgggcgtggcgtaggccacgcaggcgcgactcacaaagcccggcccatcagccctatgcccgccgtccgcatccacttgtagcagcttccatatcatgttatgataggagggactataaacacatcggaaaacgaggaggcggcgctatgaacaattttgagttttataccccgacgcggatgattttcggcaggggaacccatcttcaggtgggaaagatcgtcaaggaatatggatttaagaaggtgctggtccatttcggcgggaccagcgcgaagaaaaccgggcttctggacgctgtgtgcggcgcgctggaggcggagggaatcggttacgtgcagctgggcggcgtccaggccaacccaaccctgtccatggcgaaaaagggagtcgaactgtgcctggaggagaaggtggacttcgttctggccgtgggcggcggcagcgtgatcgattcggccaagtgcatcgcggacggtgcggggaattccggcgttgacgtgtggaaattcttcaccaaggaggcagctccggctggcgccctgcccgtgggcaccatcctcaccctgtccgcctcgggcagcgagatgagcgcctcctgcgtgattaccaatgaggagaacggtttaaagcgcggttttaacagcactacccaccggcctctgttctccatctgcaacccggagctgacctacacggtgaaccgtttccagaccggctgcggcacggtggacatcatgatgcacaccctggagcggtacatgggcggaaccacgaaggagacgccgctgacggaccggatcgcggagggactgttaaagaccgtggcggaagcaggcgcagtggcggaccgggacccggagaactatgaggccagggctaccctgatgtgggccggaagcctttcccacaacgacctgaccagcgccgggagagcgtttatgatgcaggtgcatcagatggagcacgagctttctggcatgtatccgcagatcgcccacggagccgggctctccgccctgtggccctcctgggcccgctacgtgtgcgcggcctggccggagcgcttcgcccagtacgcggtgcgggtgtggaacctggagatgaattttgagaatcccatggagacggccctggccggaatcaaggttacggaggactatttcaagagcctggatatgcccacaaatatccgcgacctgggcgtggagccggagaagatcgatgagatggcagaaaaatgtaccaatttcgggacgcgcacgctaccggggatcagggagcttggaaaagcggagatgatggagatttaccggatggccatggaggcgtaagggtaagaaagacaatcggcagcaggccgcaccagcggccgactccattcaaatgaaaaatgccgccacgctgaggggctgctgtgccataaatggcataatcggcagttccgcggcgtagcggcgtttttttgtgatagcaatgggcgattgttcgaagcggtgatccgcatacatctttcagtcggctgttggccgcagcgggtcaccggagcgtcccgtccaaaccctgtttccggctgttttacagatcaatcatctcccggtcatccggcaccagcagattcccctgataatattcccgtccctctgcggtatacagctccttgcgtcgggcgatctgtttgtcctcggtgtgccacaggaccaggttcggaatattcagctgggttgccagctcgcaggcctccttcaccgtgctgtggtgcttctcatagggctgaaagcgctcccggtccccgtagaggcagaaagcctcgtgcagcagccagtcgcttccctccacgtaggtccggcagcccggattgtagggctcgtcgcccgcgcaggtcagacgcttcccgttcttcaactgggtggtgaagccgaactgcttggccttggtggacaggatgtcgaagaaggtcacgtcgtagtccaggatatgtacggtctcgccgtcctccaccggcaccaggaaaatgcggtcgccgatcattttgtaaaatttcccctgcacggtcaggcggcagattgtcttgatggtctccaccagatccgggtggcagtagatctgcaggtcgccctcaaatgtgccctttttcatgcccgttgcgatcatacggatcatccagacgatgcccagaatgtggtccgtgtgctcgtgggtgacgaaaatgtgatggatatggttcaaatccaccttcatctcgtcgagaattttcaggattccattgccccctccggcgtccaccatgaaatattcgtccccgtcccgcagcgcgaagcaggtgttgtagcagtggatggcctgggcgtttcctgtaccgaatacatagagctgttccattgtgtctcctccattctgaaaatcatcatagattcccagaaaatgtaaatatttttctggcgcgccgggaaattgccgggatgaattctccgccggttggcgggacgaatagccgtacatattctgcggcgctgggattttaagataatgttactataatttcggggataccgcaagactttgtttggtggagtgtaaccgttcagacggctcatcttcttgaccgaaaaagaacggcagggaagcatcggatattcatccgattgaaaattgacacgaaaatccagtttatccaaacacaccttcaaaaatcaggacacccagtccaccctctcattctccagccgcgcgccgccttcctccgggaacaccaggtggtaggtgaagcccctgccgaaccggggacccagctgataactcaggtatccggccccgcgctccaggtcaaagcggatccagaagcctccctgggggaagaacatcccggacaccggcttctgctggtggcagagggagttgtcggcgggggtatacttgtcctgttccagcttccaggtgtgcagcgcagctttcttaaaatagccggcgggttccgagtccgcgcccgagcagtatttaacgatggagcattggggcagcgcgccgaaacggacctggtccagctctttcagttcctccctcatggagcggattatggtaacgcatttttccaggagggcagtcagcgccgcctcctcctttgccatattcagggcgtagatcatatcctgcttcagcgagggatctaaccgcatacggcccgtttccgcttccgccagcccccgctccagaacagaaaagggcggccaggcgtagtcggtcagaagctgtaatgcgtcctgcttgatctccagcggattggaagagagaatcaggttttgcagcaggacgatcaattcccgctcatagggcagactgtggccgtaataggggtccatgtaataatccaggcagaacagcaggcgcgctatggcgtccgggtcgtctccggtgaagattttttccaccgccgaaagcccctcctccacgatcattttttcatggtccgtataatacacggttctcaaaactgaagcctccttccatcgaatcgttcctctattggccggtcaggatacccgcttaaaacccggataatagcggaagaacaccttggctgagatatccgtttccggaacataggggtcctcccacatacgggcgtccgcggagacgttccggttgtcccccagcatcagatagcagccctcggggacttcaaaatgccggtcgtccgtctccatgggctcgggcaggtagggctcctccaggggcgtttcggagccgtttatatagatacggttgtcgcggatgtccacggtttcacccggcaggccgatgacccgcttgaccagccgggtctgatcccggccgggctcggctttgtgcttgaagatcacaatgtcgccccgctgcgggtgggagccgaagcggtaggacaggcgggagcccagcaggcggtcaccggccataatggtggtttccatggaatcagagggcacccgggtgttggcgatgacgcaggtgttgataaacagggcgatggcggcagcggccagaagtattttcagccattccagaagttcttttttccagttgacggtgggatcattgttttccttcatgtatttgcagctcctttggggtgatattgaatagtgtagcactgtcgggggcggaagtctttactaaattgttaattgtgtatttcttttttgggagggtttgaaaactgggatattttgtgttactatatttttaactgtttgaaaaggatggaacaagggaggcggaagaaatgagggatttggcttatttaaagctgttgtccagggagtatcccacggtgaggtcggctaccagcgagatcatcaacctgatggcgatctgcggactgccgaaggggacggagtatttcttcagcgacctgcacggggaatatgaggcgtttgtccacctgctgcgcagctcctccggcattatccgggagaagatccgcgagaccttcgggcacctgattcccgaggaggaggaagtccagctggcgaacctgatctattatccggaccggaatctgggaaagatccgcaagacgggactgtttaccgaggactttcagaagatcaccatctaccgcctggtgcagatctgcaaggtggtgtcctccaagtacacccgatccaaggtgcgaaagaagatgccaaaggaattcgcctacgtgatcgacgagctgctccatgtggattacaacgacgacaacaagcggatttattacagcgagattatccactccattatcgacaacacagtggcggacaagttcatcatcgccctgtgcgagctgatacagaatctgaccatcgacaatctgcacattatcggcgatatcttcgaccgtggtcccagggcggatatcatcatggacgagcttatgcatttccacgatgtggacatccagtgggggaaccacgatatttcctggatgggagcggccacgggcaacctggccaacatctgcaacgtgctgcgcatcgcgatcagctacaacagcttcgacgtgctggaggacggctacggcatcaacctgcggcccctgtccatgtttgcggctaaggtgtaccgggacgacccctgcgagcggtttgtccctcatatattggatgaaaatgtctacgacgcagtggatccgggtctggcggcgaagatgcacaaggccatcgccgtgatccagttcaaggtggagggcgccattatcaagcgccatcccgagtacggcatggcggaccggattcttttggaggccgtggactttgagaagggcacggtgacggtggaggggaaggagtaccccatgctggaccggaatttccccaccgtggacccggcgaatccgctggaactcaccgacggggagaaggagctgttaaaaaccctgaaggcgtccttcaagcacagcggacggctgcacaagcatgtgaaattcctctactcccacggggctatttacaagtgctacaattccaatctgctgtaccacggctgtatccccatgagggcggacggcaatttcgacagcgttatggcgggcaatgccatctattccggcagaagcctgatggattacttcaactatcaggtgcagaacgcatattttatgcctgagggctcggtggagaagcagtgggccatggatttgatgtggtacctgtggtgcggttccaagtccccggtgttcggcaaggataaaatgaccacctttgagcactattttattgcggacaaacagacccacaaggagacgctcaacccctattacaagctcagcgtgcaggaggaattctgcgaccggattctggaggaattcgatctcccggcaaagggctcccacatcatcaacggccatgtgccggtgaagatgaaggacggggagactccggtcaaggcggggggcaagctgttcatcattgacggcggcctctccaaggcttaccaggccgccacgggcatcgccgggtacaccctgatctacaattccaaccacctggcgctggcggaacacatgccatttgatcccaacaaggagagttcgccccgggtgtccgtagtggaaaaaatgcagagccgggtgatggtggcggacaccgacaagggcagagagctggcggggcagatcgcggatttaaaagaactggtggcggcctaccgggaaggcacgctgaaagaaagggtagaataaatgaccaagacggaatttttgcagattctccgggaggagctggacgggcgggtgccctactccgtgatccaggagaacctgaattattacaacagctatattgacggggagacggccaagggccggcccgaactccaggtgatcgaggagttaggcggccccaggatcatcgcccgtaccatcgtggacgccactctggacaccgaggaccgcccggacggcttccagtcctacggcggaagggaggagtacgacggagccgcaaagcgcaccgcccagaaacagtatacggagtacggggacggccaaaagcgttcggtacactatgtggatttcagcaaatggtatgtgcggcttttggccggtttggccggttttgcggtgatttttctgctgatcacgctgtttatgggcatcttgggcctggccggatggattctgtccgtggtatggccggtgctgctggtactgctggtgatctggtttatgaaagggccgagaaggtagagatgagaaatgaagagggagggcatccggtgtgaaaacggatggcctctttttggatggctgcagtggaccgcctgcccgctgcaataggtgatgcaaaatagcacaaaagacggctgtggatgaattgatttgcctcccgcagaagcagataatggatttgtacagggcaatatagagtatctgtacgaagaagagtgaaggaggggaatcgatgagagcagcatttgtcacagaggttgaaaaggtggaggtgaaggaaattgaccggcctgttatttcagatacggaggtcttaatcaaggccaggaccgtgggcgtttgcggttcagacctccacctgttccggggaacgcatccgtttcgccgcgcgccggccattttaggccatgaaatagccggggagattgtggagacgggaaagaatgttcaaaagttcaaggtgggcgaccgggttacggtggaaccccaggtgggctgtggaacctgtgaaatgtgcagacgcggttgcgtgagtctctgcggggaaaagaaggtgccgggcactgcaaagtggattggcgcgttttcggaatactttaatgcggaggagcacacgctgtaccgcttgtcagatgaatgcagctatgagacggggacattggcggagccgttggcagtggcggttcacacggttaaccacgcgcggaccaagtcgggagcattggtgattctgggggcgggaaccatcgggcagctgatccttgcgtttgcaaaatggaagggctacggtcctattatcgtgaccgacacagcggagtttaatcgtgagtttgcactaaagcacggggcggacgccgcgtttaatcctctggatcaggacgtgcctgcggaggtgaaaaagctcacgggcggtggagcggacctggtgattgtggcggctggggcggacaatattctggatcaggcatgccaatgcgcttgcaaatgcggcgaggtgggcattgtggcgatgatcacaggcaggattcccttttacagttacgcggtggtattcaatgaaatcgatctctacggcgccatgtgttatgagccgaaggattttgcggaggcggtggatttgatcaacagccggaagctaaagctggaggattatgtgacgcagatcgtggacggcattgaaaagacccaggaggggctggagcttttgagccggaaaacggaagatgtggtgaaagtattgatccgtatggacgaatagcggaatatgtgctgggaaaggaaggaggcttatggtgaaagaaagaccggaacatattttgctgggctgcgttgcggatgattttacaggcgcaagcgacgcggcgtcgtttttggccggacgggggatcaagacgctgctttttaacgggacgccggacggccatgagatccttcaggactgcgcggccgtagtgattgctttaaaaaccagaagtattccggcggacgaggcggtgcgggagaccttaaaggccgtccgatggctggagcagcacggggcggagcagttatatctgaagtattgctccaccttcgactccacgccggaggggaatatcggcccggacatcgacgcggttctggaggcgtacaagatcccctatacaatcctctgtcctgcgcttcccgtcaaccgacggattgtaaaggacggtattctgatcgtggatgacaagccggttgcagagggacatatggccaatcatcctctgaatccaatctgggactcccggatcgaggaactcatgcgtcctcagggaaaatacccatgcatgatactggacgggccccttctggcaagaaccagggaggcaatcctggaggaagtggaaaaatttgggaaagacaaagcgcatttctacatcatcccggattataccacggacgcgcagggaaaaaagatcgcggatgtatttggagataaccgcctgttgacaggtggatcgggcattctcgaacatttggcggagcggtacaaagagcggtatgactgcgctgccgggcaggcgcttcccacggggacgccgggaaaaggggttgcgctttccgggagctgcagtatggccacctgcggacaatgtaaggcttacgcggagggccacaggacgttttctgttgatccgaagcgcattctggacggcagcctgaccgcagaagatttgtggaaatttattacagagagcggtgaggacagcctggtgtacagtgccggggccaccgacccacagagccggatttatgcggacgaggagacagccgagagagcggcgaaggcgctggagcagacattggcagcgctggccaaaaaggcctttgaggcggggtatacgagaatcattgcggcgggcggggaaacctccggcgcggtggcgttagagctgggatttgacggctttatcatcggagaaagcattgccccgggagtgcctgtcatgattccgctgaatcatcagaatatcagaattgcattgaagtcggggaacttcggccagccggatttttttgagcgggcgctggcggtgatgaaagccgattaggagaattcaaacaggcagacataccgggaacggatgtctgcctgcgttcatgtgattggtggtttaggatgggaacagctcgctctcgatccgcatcagccggttgaatttggcgttgcgctctccgcgcacgggcgaccccatcttcatttgctgggccccgatggccacggccaggtcggcgctgaagtcgtccagggattcacccgaacggccggaagcggtgatgcggtagccgttgtcaatggcgaacatagcagttgagaaggcttcgctgaccgttccgatctgattgattttaaacagcagcgtatttgcggaattgtgtgcgactcccatttttaggcgttctatatttgtagcgaacaggtcgtctccggataccatgatattcgggacagcggctttcaggcgggcgtaatcgtcaaaggcatcctcctcaaagggatcctcaatatagatgagcggatagtcccggcagaggtttctgtagtaggtgcacagctccgccgcagtatagcgggtccgctttttggacagaacgtaggtgttggtattgggatcatacagctcgttggccgccacatccaggcccaggtgcacgcagctttcgcagcccacggccctggcggcgtccaggatgattgcaaaggcttggtccgtggagtccagctccggggccagcgcaccggcatcctccaaacagtaggacacccgttttaaaatccgtttgagcatctcttcccgcatcgccagcagtgcctccgtggcctcagaaaaccgggtaaagccgtccagaatcagcaggtagtcttcaaattccaggccggaaggggaaaatgcgcctccggagatcacggtggaggagatggcgggaatcctgcgcggagcgaatccgcccagatagcggtaaagcggaaggccggaagccagcgcaccggcttttgcggccgccagtgagaccggcagaatcgcatttccacccaaccggcttttgttgggcgtcccgtccagctcgcacaggatgcggtcgattttcgcctgatccgttacggacacgccctttaacgcctggcaaatctcgttggacacaccggcggaggccttggtggttccaaagccgttgtaccgcgttccgccgtcgtacagctcgtaggcctcgtaccttccggtggaagcgccgctgggagcggaagcggtcacggaaataccgttcgacgtggtcagcaccgcttccacggtgggttttcccttcccgtttaaaatctcatagcctttgattgactcgattgttgcgttcaaaataatgcctcctttgggtattaaaatagatttccattttcatcgaatttcagttcgcggggagcttctaacacctcgatattgggattgtgtttcgcctcctccatcagcgcttcagaaatttcgatgtcctgcagatgcatggtgtcgcggattcgcaccatgcgcagcttctgccggtccgcccccagcgcggaccggatggcggctttgatggccagttcctggttttccatgaacatggggattttgggaacctcggtgccgccggttgtcagcgaatttgcgtatgtaattccaacgtctattttgtccacaaagcgctgggtgatgatgtccagaaccccgactccatgggcgtttccgtgggaaccatcggataagtccaggactaccacctgcctgggacgcccctcaaggctgatgttgctggccgccttgtaggtatgggtgacgttgggatccacgccggcgccgctgatttcttttccgaagtaatccacaacgaccacgtcgagattgtcaaagagaatccgtggcatcatggagcgggccagattcaggtaagccggctcccggtcgatgatttcctggggggtcagcgcgacaatcgtgtttggcttgtcaagggcgttctcaatggtggcgacaccgaacaggatgttcgcatgggagaggatcgcattgccgaacagttcaatggactcccccatcctgtcggcgccgcgcccgtggactgtctgcgcgccgtattgttttccaaggccaatggccatgattttaaacagcccgctctcgtattttccgcggaagccggtatggggcttgatgcggtttacgacgatgatgccgtcggcttctttggcatatttgtcaatgtagaccggcgtgccgtcgggcaaatcgcagatgtatgcggtttccatggtcgcccggatgggagcgcccatggtttcttccgtgatgccgtactgtctcaggatttcagcctggccctcagccacagcgccgccgtggcttcccatggctggaatcaaaaagggttttccacccagagctttgacgaaatggaccgtctcctggagcatgatgtccatgccctcgatcccccggcttccggccgtgatggcgatgtacatgtccggttttacggcaccgatgatctcgggccggttcagcgcctgccttaccgctgcggggatatcggggagagtggtgtcgggcagcttctggcggacccgggccattttcgggattttttgttccgataaaatggttcggatggttttattgttgcggatattcatgtgctgtctcctccgtagcgtgaatgggcttgcgctattctgtgatgagaataatgcctaaatccagaacgctgatattgtgcgttgcctgaatgccgcaacccaatttccagagtggctcggacgccgcgtgggtgtccaatacatggtaaatatcgattccgttgttcctggcttcttccatggtatatccgtcgatgatcgccccagccaggcagtcgggagcgcccggaagttttaagccgcccgggccgtccgtcccgtctgtgtccacggctccgacgactatccgcttgctccctgcgatttttgcagccgctgccaggcagtattcctggtttcttccgcccacgcccttgtgattgcccaccgttaccaccagttcgccggaggtgaaaatggcgcagggcgctgcaaagggttcgtcggcccgctcacagttcagcgcgatcaggccgcttacaaaaccggcctccctggcttccgcgcagagatattcacagagcatatagggcttatagcccagctcgacggctttttcgcggaccgcagggtagagggtttcgtatttgggcgtcaggccaaagacgcgggcgttttggctctcatactcttgaagcttcaccgtttccccggaagggtccgcctttagaaagtaatcctgaatgttctgcggtgtgcggtcccaaacgtgatagcgacgaaacacgtccatggcgtcggcaaaggtggtgccgtcggccagggtggcgaggaaacggttgtttttcatgaatgtttcgtagtccatgcgcagtaccggcgtgttggtctttgcgatatccgttgtaattaaatggacgagggtcgccttttggaacagacgcgatatttttccgcccttcatccggtcgaggtgggtgcggatacagttgaggtcttctgtgatcgcacccttctcgatttgcagcatatgggttaaatcccgcatctcctggagtgaaacgccctcaatgggccaggtcatcagcgaggaaacgccgcttcccacaatggtgatcaccaggtcccgctctgtaatgtgctcggaccactcgtatatttttttgcaaccctccacgcagagatcatccggaatggggtgcccggccagcgtcacaccgatctttttacagatcagcgggtcgccgtgcttgccgatgacgtgtccgccggtgagataatcgccaagaatctcctccagggccagcgcggcccgctgtacgccttttgccgcgccgaccacgataacgcggtcgtaatgcttgaggttgtagacggcgggcccgctccggggatcattttttaactcgaattccggcccgtcaaatatcaggcagctgccttccaaacggacgaatcgtttgactcccagatatggatcgcagacactgagcccggcctccaaaagctgggccatgtgattgcgcccggtttgatttccgtgactggtcagcatctcaaaattctggattctgctcatagttgtctcctttcggttgttgtaatggtttgctgccgcgcaaagcattaccggaagatttatcaccccctgtcctgatacagttacaatggttcgctgccgtacaaatcattgtcctggattttatagatcaatgttcaaatcccttctcttgcgccagagcgtactgcggttgatccccagccgtttggcggctttggaaaagttcatgttctcttcgagcagtattttttcaatgatatttccctctatgacatcgagggtggaatccaggctgagccaggaggtatcagtgttgcggatatcggggtaatttaacgccgatttgacttcatccgccgtgatataggatcctttggcagatgaaaccagcatccgaaccgtccgctccagctgatccagattcacactccagtggaaatgctggagaagggtaatggccgccggttcaaagccgatcacctgctttgaaaatatttcattgtaccgggatagaaaaatactggcgatggtaggaatttgctcaggacactcatttaaggagggcaggcgtatgggcaggccgtacaatttgttgtaaagggaatgtcggaaccctccgtttttgacaagctcgtgtatattgccgtatgcgctgcaaatcacctgattgcgccgggtgagcagggtgtcttcaatataggaatctaaaatctgctgcatcggatcggaaaggcactggagttttttgaaatagaccgtacagttattggaattcaatggagaatttacattatttaccagtgactgccagtatttttcggtgagcaattcgcagttgacccggataaacgggttgtttttgtagatgctgatggaatggatgaaacgtacgcactgaacggtgccggttcctgtctcgccgtagataaatatgggaaagacggacgtgttgctttcccggatctgctggatcacggatttcgttttctcatcagcgatgaactgaatccccatgtcgatttttgcgtgccggtcgtactcgatctgcacgcagggagagggggaggcccaggcgatgcccgtttcaatgtaaaatgtaaagaaaagttttcttccagtgaaacgtaccgccttgacgctgtaaatctgagttttgctgcggattgtaaagtatatttcttttttgtccgtgagttccttactgcggttgagcaggctgttttcaagcttatcggttaagatggattccatggcggcatttttgtaacagcattcccaggtgctcgtataaattgcaatacaggtgccggttgcggagagaatttcgcggagcgggagatcctcgctggccattttatagatctgggacacaatgctgccggcctcggacagcgcgtggttgacggattccctgccgtagttgagtgggatggtacagagtccgaaggaatcggcgatacctgcgcagctcatgtcggttatgaccagattgattttctcctccaatacggttgaaaagcagctgcgcgcctggcggtcgttctgatattcgtgtaaatgaagtttctcgttgttgatttccgccagtaaccgcgcggacgatataacgtcgggactgccaaccacggcaaagggctcgttgcagcactggcccgcccggatggcccgcaaaatgtcgtaggggctgaattcaaggggcacggcgggaacatcgatatatggggttaaaaaggagatgccttcccgatgggcaatgattacgtccatggctttttccgtgaccgcttttcgaatatccaataaaatggtttccgcgttatagactaagacggacaccgacaattccggaaattttgtcgcggcctgctggaaaatagggcttaactcctcataagggacaatggcgagtatctgaattgaggctatcacgtggacctcctttctgttgcaaaataaaacagttttgtaagacgtttttgagtatgtcataagaatatataaaatatgcacatataacaatgggagaaaaatgggaaaagggtgcaatttgcaacaaatataaaatgcaggagcgttgcggctgtctgccgttttctttataatgaatgtaaagtcgctgccgcgaatctgagataccggacaatttagataagtaaccttgtgtatatctttagtatgaatcatacgataggaggattatgatgaaacgaaaagttatggctatattgttggttttagcgatggtttccgggttagcagcctgttcgaaagtcccgtcaggcggggaagcttctactcaggctccggcccctcagactacggcgcaggcggtggaggagactgagatggaatccgcagaggagacggcggctcccgaagcacagcaggaagccccggcccagggtacgtttaagcccctgaccaaggaagagctggaggcgatcaagcctgccaagttcggaagaaaagcgatcacctatattgccccttacagcgcaggcggcgcggccgatctggtgggccgtaagcttgccgctattgcgggagaaaagtatggggtggatgtggttgttgagaatgtagtgggaggttccggaaccattggcgtcttacagtgcctgacgtcaaacccggatggatatacggtcagccttctgaacgccgcatttatgggacaatgtatccaggggcggcttgatatcgactgggaaaaagatatgacggttttatgtaaggaagtggaagatgtactgggaatttatgtaaaggcagatggagatgtaaatacctgggaaaaatttgcagataaggtcaaaaataatcctcccggcaccgtgacaatgggacttgccggaaccctgtccgcaaaccacgcctgcgtgctggcgttgggagaagcgtttggcgacaagaacattttcacaattcccatttacggcggagcagcccgctccatcacggagatcatcggcgggcattgcgatgctacggtgtgcaaaccggcggactgtatcaaccagctgaaaaacggggaagttgtgtgtatcggatattttgccaataacagagttgaggcgttcccggatgttcccacagttcaggagtttttcccggatgttgtgatgtggggggatccggactatatggcgacctatttgattacgaacgcgggcgtggacgaggagattgtcaattatctgacccagctgttcgtcagctgtatcatggacgaggatttccagaagcttgccgctgagagcggattccaggcgatcaatgtccccacgggggaggatgccttccaggcagccaggggactttacagcgcattagttgaaatgaacaatatcttcgcagatgcggaagaaggagtcaacgttcaataatcggtcacgactgttttataccagatgcgggcgctgttttaactgtcatctggtataaaacgcttatagaacagttttggaagaaggaggacggtaaatttgacaaatgaggttaaagaaacgaagtttttcgaattgattctggcgctttttttttgctgcttctcgtcgtttatgctctacacggcttttaagagccagaagtctttgaaccagacggtgaaggtcattaaggccatgaccatgcccaagattattctgacaattatgctggcgatttccctgtatgtattgggcgttacgatattctggtatataaaaaacagggatgtgggaaatatatggccggatttcctgcatctgtttacgaaaaaaaccgtgtttacatttgtgctggtggttttgtacgcctgttcctggaaatatctgggattctcaatttccacatttctatattttacagctcagtcgaaactgatcaagccgggaagaaccgtccggaaaacgttgttgatttccgggatctttacggcggcggcctatctgcttttttccgttggatttcatatgtttttcccggagccgatacttgatctcattctgtattcctgacaagaaagggcggtgattctatatgcaggtattgtcatatgcattttcttatttatccaatccggtttgtatgctgttctgctttgccggaacctttatgggcctgacctttggtacgcttccggggcttacggctaccatggggattgcgctgctgatccccctgtcctacggcatggatccggtaacggccctgggcatgatgatcggatgctatgtgggtggaattgcaggcggggcggtctcctccatcctgttgaatattccgggtactccgtccgcgattgtgacagcctgggacggctatcccatgatgaagcaggacaggggagcccaggccatgggatgggcggcctgcgcctccggcttcggagggttgtttagctggggtattttatgctttttctctccgtatcttgcaaagctatgcgtgaatttttcctgtacggagtatgcggcccttgcgtttctgggtctgatgatgatttcttcggttacgggcgataatgtgtttaaggggattattgcggcgttattcggaattttcctgtccatggtgggcgttgatatcgagtggggggatctgaggtttaccttcggcagctacaatttgatggggggaatcaatcttctcccggtgatggtcggcttttattcccttccccagattctgaaggtctgcaacgacccggatgtcgagcgtacggtgaagattaagctgtcgaattttctgccgaaagcgagggaatttttcaagtataaatggacgctgctgcgcacctccgtgctggggacgctgattggaattataccggctaccggcgccaatgtggcttgctttctctcctatgacctcaccaagcgcttttcaaaacatcccgataccttcggaaagggcgacgtggagggcgtcatcacatcggaatgcgcaaataacgcagtctgcggcggcgccatggttcccctcctcacgctgggaatcccgggggacggcgtgacggcgattctgctgggcgggctgatgatccatgatattcagccgggaccgtccatgtatctggaacaatatcccattatcatcggcatttttacgtgtatgctggtctgtaccctgatgatggtgctgattcagatggtgggaatcaaattctttatccgtctcttaagcgttccaaatgatctgctcgtgcctgggattgcggtgatgatgaccatcggttcctttgcgatgcgcaataatctgtttgacgtggggatttgtttggtgctgggaagcctcagctattttatgggaaaagcgggatatcccattgcacccgcggtgctgggattggtgctgggaggcacgtttgagaaggagctgcgcaccgcgatggtgctctctgggtataatccctttgtatttttaacgaacccggtttcctgcgtttttgtggtgaccggtattgcgtttgcagcgtggtcggccgtgcgcagtatgcgggcgagaaaatagcggatagggggtggaagcatgaagaagattggaattaccatgggagatccggccggcatcgggccggaaatcaccgcaaagatgctggcggacccagcggtctatgagcgctgcaggccattggtggtcggcgacgcttccgtgatggaggaggcgcttgctctaaccggtctttccggcacattgcgcattcacagaattagggagacccgggaagcgctgtttcgttgggggttcattgatgtttacgacatggaactggtggacatccgggagctgaagcgggggcaggtttccgtgatggcgggaaacgcggccttccagtatgtcaaaaaggtgattgagcttgcaatggcccgcgagattgacgccacggtcaccaacccattgaacaaagaggctatgaatctggcgggctatcattttaacggtcacacggaaatctacgcccattataccggaacaaaaacgtactcgatgatgctggcccacgagaatctgagagtggttcatgtatcgacccacgtctccctgcgggaggcctgtgagcgcgtcaaaaaagaacgggttctggatgtgatccggatcgcgtatcaggcgtgcaggcagttgggaatccggaaaccgaaaatcggggttgccggattgaatcctcatgccggtgaaaacggaatttttgggagagaggagattgaagaaatcacaccggcaatcgaagcggcggcgctggaggggatttgggcggagggaccgcttcctccggatacagtgttttccaaggcgaaaggcggctggtacgatattgtagttgccatgtaccacgaccaggggcatattccgatgaagatagtgggctttgtgtacagccaggagaaaggccggtgggacacggtcgccggggtcaatgttactctgggtctgcccattatccgggtatccgtggaccatggaaccgcctttgaccaggcggggacgggacttgcaagcgaacaaagtctgaggaatgcagttgattatgcgatatgtatggagcctgtaggggaggagaaaacggattgactccctgccggacacggaaaaactccccgattccctcaagcgcgaggggatcggggagttgcagtgtacgaggttttttgattgccaaatgagatttattcccaaaatcccaactgcgccccgatccccgccaggtaaccagcggagaaaaccgtgtcctcagacaggctctttaacactcttccctcaattgtaatggtgccgtcgtagcccagccccttcagctggcgcatgattccggcgaaatcgatggcgccgatgccggggaaatagcggttgttgtcggacacatgcaggttgtggtaatggccggcatacgttgtcagcgccgccgtggtgctcgtctcctcaatgttcatgtggtaggtgtcggggagaatgtacaccgggtgggagagcccggcggtgagggccgcgccttcctccagggtgttgaccagaagggcctcataatggttggtggcttccaggtagaggggggccgccgcggtcttgcccaaacggtccagctcctccagggaggcgcgcagctgttgggaggccacggctttgtcgccggagggcccgcccttgaggaagccgcagatgacgcccgctccgaaccccgccgcgcagtccagcattccgccgagggcctggacgctcctggcgcggacaccctgatccgggctgctgagggacaggccgttacggttggcaaaggcgccggaagcgatcatggtcagccgaagtccaaagcgttccagcgtctctttcagccggaccgcgtaggcctgggagaagtccagcagattcatctcgacgccgtagaagccggaatctttcagcagtttgagcgtatccagaaattccgggctgtccagggactccggggctgccagctggatgcagaggggataggggtagcgttctgtgtgcatgggaaatacctcctgtggtggattcccgggaaggcggcgggccgcgcccggacgcgcctgtccgcggggaattagaatgattcgtatgatcctatgataagcgatctccgggaaaaaagcaacgcggccgacagggttcgcggtgattgcatcttgacaaaattacaaaaataaaatatactgtataagaaatgtaacatttatgtaacatttttgataaaactgtaatcgaaaattggaaatagattgatttgcgaggtgcaaaaagcgtgaaaacgatatggaagatggcaggcgccgcctgtgtaatggggctgcttctggtggcggaaccgtcggaggcaagagcggcccagttcggaccagaggtgaccaacacatccacctacgtggtgaagatcgaggccccggaggtcgaagtacatacagcggcaaacacgagctccgccaaggcgggaaccgtgaagcggggacagacctatcaggtgttgtcccaggcggaggcgggctgggtgaagatccaggcagaggacgccgcaggatacatccgcgttcccgggaacgcctctctggtggaaaagaccagccaaaaggtggatgagtccgtgaaaaagcgccgtgaaaccgtggaatacgctctccagttcgtgggcggcaagtatgtgtacggcggaacggaccccaacagcggcgtggattgctcgggatttacccgctatgtcatggcaaaagccgcttccatcagccttccccactcctccggcggacagtcgtcctacggcagagaagtgacggtggatcagatgcgccccggcgacctgctgttctacagcagcggcagccggatcaaccatgtggccatgtatattggagacgggcagatcgtccacgcctccacagaacgcacggggatcaagacctccccctacaattaccgcaaaccggtgaagattgtcagcctgctttgatgcaggctgtatttttttgctgtattgggactttggttcaggctgcggctcattccatatcccttgccgggaacctgactgaggaggaaaacgcgggtatgggtggagcgccgccgccggaataattcggtgcagcatttttctggaatgaaacagaaatttaataaattggtagcatttgccagaaaaatcagcgataaaacggctgaagccctctggaaatgccccccgtacggcggaaaacgcgtgagttcgtaatctggccgtaaggatattgtaaaaaacgactaaaaaatgttaaataattctaaaatagttgacgaatctcaagaacctgctataataagtttgtaacgaatgtaatatttgcgtaacaattacggacaagtaaacggaacatgaaaggcaggagattttgttgaataccaggacctttagatattttttgcggattggtgccatgtgctctgtacttacgatggcggcgccccagacagctctggcggcgattggaccgggatttgagccggggacttacgtggctaccgtcacggcggacagtgtgaacatcaacaagagccgggacggggaggatgttcttctcaccgcaaagtcaggcgatacatatgaagtgttggaagatatgggaaacggctggatgaaggttcgggttctggacacggaggggtatatgccggtgtccggcaacgccacggtggaggaagtcgccggtgaggagatggctgagattcagcaggaggcgctcacctcctccaacagctaccgccgccagcaggtcgtggattatgcgctgcagttcgtgggcggacgttaccgctacggcggatccgatccccacagcggcgtggactgctccggctttacccgttatgtgctgcagaacgcggcgggtgttgggatgagccgttcttccggttctcaggcggcccagggatcagctatcagcgcggatcagatgcagcccggagaccttttgttttacggcaacggcagacggatcaatcatgtggcgatgtacataggcaacggacagatcgttcacgcgtccaccgagcagacgggaatcaccatctccccctggaattaccggactcctgtgaagatcacaagcgtgctgggttagacggattgctagcaatgttcagataaaaggatattcaaaaaggaacggggaaagccgggagcggaggtgcttccggcttttcgcgttatattggatttctttgtaaaattgtatactgcgcagaaaaaacgccgtgataggggagctatccggcgttttctcaaggggagtataaataattaataaggatgaggaaatggtttaagggaaaccatttttcctcatattagttataatatatttttcgcgaaaaagcaacacctttttactgctgtgagcggccggaaattcccttaaaaacggcaatttctgtttttttcgccccgcccgggcggtcttgatactgcctattccgttctggaataatccctacaacttatccgaattagacttgtgaaccgacaggctatatgattaagaaaaagaatcatatttgaggaggtatcacaatgtcacaaccgcaatacggcggcgcttccctggcggaggcggtcagagccgcatacgccgaagggatggacgattatcatttggaacctatggttttgacggagggcggcaggcccgtgggcaggatcgccgacggggacagtgtgattttctgctgccgccggggagagcgggagatcgagctgaccgacatgttcacggaccccggtttcgcacaggttccccgccgccctcttaaggacctttattttgccatcatgaccctatatcacgagaaatttaaggatttgcccatcgcctttgcgccctcccgcgtggaaatgccgctggcccaggtgatttcccaggccggaaaaagccagttccactgcgccgagtcggagaagttcgcccatgtgacttttttcctgaacggcggggagaacgccccgtttcccggggagacggacaagtgcatcccttcccccaagggcgtaccctttgaccagaagccggagttgtccctgccggaggtggcggacacggtgacggaggcgctgggccggtatgatttcattgtcacgaattttgcaaacggagacgtggtgggacacacgctcaattccgctgccaagctggccgcctgccgggaggtcagccgcagccttcagcaggtggtgagcgccgccctcagggaggactatgtggttgcgattaccgccgaccacgggaatatcgagaagctttacacgcccgcaggcaagcccgacggagcccacacggataaccaggtggcctttgtgcttatggatcccagaaagagcggacccatcgcgctgagagatggcgcgctgtccgacgtggcgcccacggtgctggacgtgatggccataaaaaagccccgggaaatgaccggggaatcccttgtttcgggctatgagttcggccagggccgcaggatgctgctcatcattctggacggctggggtctgggggatcagacgggaaacgacgccatttttgccggggacacccccttctgggacgcgcttgtcagcgggaagtcctggtccaggctccacgcctccggccaatacgtggggcttggcgcgggcaagccgggcaactccgaggccgggcacatcaacctgggagcgggccgcctggtgctccaggacgacgtccgcctggacgcggcggtgagggacggaagcttccggaagaatcccgtgtttctggaggccatcgaccgctgccgcagaaccggccgggcgctgcacctcttgtcctacctgacctacaagtcctcccacggttccatcgactaccccctttccatctgcgaaatggccagggacctgccggaggtatacctgcatatcatctttgacggccgctccaccgagcccggctccgccccggaaatgcttcaggcattggatgagaggctggcgcggatcggcggcaatttccgcgtggtggacggcgtgggccggggccttgtgctggaccgggatcagaactggggaaatgtaaagcgggcctacgacgccctgacagacggcatggaagcccgtcagtacggggaaggctgactggaaaaaagatccagaaatttccgctcccaccaggtcagcggcacgtttttccggcagacgcagtccacggtgcgctccagactgacatccccgatccggcaccgggccagctccccgccggagagctcccgccggacggtggcgaggggcagaatggacacgcccatgccccgcatcaccccctgcttgatggcctcgatatttccgaagtccagaagcctgggggagtccccgccgtgggttttcatcagccctgtgataaactgccgggtggcggagtcctgctccggcgccagcatggtgaggcggcatatgtccgcccaggggacggatttgcccgcaagggggtggtccgtaggcagtaccagggccatttcctcgcgaaagagcggggcttccaggtaaccggcgggcggttttacgccttccacccggggcaggattgccagggaaaccctgccgtccgccagcagggagacgattttggcccggaagccgactgtgaagcggatctccaattccggaagggactggcgggctttctggagcacggtggggagctggtagaccccgatgctgttggtggtgccgagatacagggttttctggctggcctggcctgccgcggccagctcctcctgaagccgggcgtagccgtccaggcaggagacggcgtaggcgtaggctttctgcccgctgtcgttgagcaccaggcggcttcccttgcggtcgaacaggcggcagtccagctcgcgctccagggtgttgatctgtttggagagggcggactgcgtgcagaacagcttttccgcggcccgcatctgcgtgccttcctcggccagggtccgcagggccagcagtttatccatatccattgtgttactcctttcaaactataaaattcggagggttcctgatcatgcaaaataatcggatcgccgtcacttcgctgggaggcagcggcgaggaggcgcggaattgtttcctgctggaggccggaaaccacgcggtgctgctggactgcggcgtgcgccgggaagcgctgggggcgcttgatcatgtttatccggcgctcacccgggaaatcgccgggcggctcaccgcggtgttcctgtcccatgcccacgaggaccatgtggccgcccttccctatctctatgaacttgggtataggggaaatgtttacggcacggaggaaaccatccggctggccgggggatttatgaaaaagtgggtggattttgtggctgccgcgggcgggaggcttccgttttcggtggaaacgatgaagcgggtggcattttccgccatctctctgggcagccaggtggtagagggcctttccgtgaccgccgggcgcagcgggcatatgttggggagctgctggctacggtttgagtacggcgggaaaagcctgctgtacacgggagatatgacccttgcggggcggcttctggccaccgatctgccgccggagtccgacggggcggtggtggactgcgcctacgccgggcgcgtcctgtcccaggccggacagtacggcgcgctggtgggcctggctgaggaggtggccgccgggggcggaaagctgctgctccccgtgccgccgaacggccgggggagcgatattctgctccatctgtgcgaaaatctgcgcggggtgccggtctacgcggaggccaatgtggccgctctgtgtgtggaacttttaaaagagcggaaatggctgcgggcggatgtgggcgggcggataaatgaggcgggggagcaaccaaacggcatgggcctgccgggagaccggatagacgctgtgagccgggcagagacatatataaacgctgttatcatcccggacggcccttcccgctccctggccctctctgcgcccggccccgccgtctacctcaccggcgacggcatgatgtcaagcccggccgccgcggcctacttcgaggcgctaaaaggcgacgcacgaaactgcatcctgatcaccggccataccgcccggagcgccctgggttcccgcatttttgactcggctttccgcgctcaggcggggatcgccgcccgggcgcagcgcctgacgatcaaggtgcatctggacgaccgggatgtgatcgctctcaaccggtccgtgcgggcgaaaaagatcctgcttttccacgcgccgcttgaaaacacccgtgaactgaccggcaagctgcaaaacctgggcgtggacgcccggtgcggtttggaaccccgggcgctggaactataaccccggtgcggcttggccccccgggcgctggaactataaccccggtgcggtttggcccccccgggcgctggaactataaccccgccgcggcccgcctgccgcgacgttttctgctccccacctaaacccctctctgctgaatctgatactgcttcggcgtcacaccggtggtctgtttgaacaacatgaagaaatactgcttattttcgatcccaacctgcccggccacgtccttgaccttcacgctgggatcccgaaggatctcctgagcccgggcgatgcgcagctgattgatgtaatcggtgagggagcagcccttggcctggcggaagatgcggcacaggtatgcggtggacaggttgaaccggtccgccaggacctgggaggacagattggagtcgcagtaggattcttcgatggctgcgatcacctggtccaggctgctgcccttgcggctggcttttttctgctggatgtgctcggcaatccgggtaaagaccgcctcgcaccccccgttcagggcttccggggagaagcgcagcgactccgaaaccgtctggtatccgccgtccgggtccgcctccccggggaaacactcaaaatacagctttaacaccgcgccggacagggcggcccacgcgtactgcacgcagcggccgctctttccgtttaatgaggccagaaactccagatacgcctttccggccttgccgccgtatccctttttcagcgcatcgatcacatctgagacccgcgcctccggctccgccggggaatcgtccagctgcgggtaatcctgcacaaacaacatcggtccgttctggtacaggaaccgaagctcataaaactccacaagcctcccatagacccggggcagggcggcaaagtcctccgcctccgtccccaccacgaaccaacgggcggggaactgtgcggaaagccggtccaaaacggcctgcggctcctgctcggcctgcaggaaaaggatggtgtactcgttgtgcacgatcaccccttcgcagcgggcctgaccgtcccgaacgcactccaggtacagaggaagccgcagcccgtcgatcagacagaggcgaatgggccggtctgacagaagctgtaagtcgtactcccggatcaatgcctcggggctctcgtattcctggctgccgaacagcaggccctggaggacttctccgcgaaccatggctctgagggaggtctggatctgccgggcgttggaattgctctcgatcagatggttgaggctttccagcatggcgtctgtgttctggggcgcatccggcgcgatatcggagatgcgccgcgtgattttgcgcagcggcacgtagatatccacggagatcatggtgcccgcaagcaacaggataccgaaaccggcgatcacaaacaaaaaggtctgttcctccgtgtgccttaagtcctccaggcactggtcgtagggcagggatttcacataataccaggggcggtccggcatgcgcgagaaaaagcagatctgccttccctgcgcctggtagataaaatagccgctgtccacgccctcgccggtccgggacagtattttttcggtcagaagcgggtagagctcctcgccttcctgggccgaggaagccaccagaacgccgtcctcctttataatgaaggcatcctctccgccaaagtaaaggcggttcagccagtttttgctgatgttgaacatgatcgcgttgtccttgggcaggccgcttcggtccagctcaaaaaacaggaaggaataaagctcccggttgctgtaaatattggaaacgtcggagtggcggagaatcgggaccagacgcccggcttcagagcggttttcaaaaagcgctaccgcgtcccggtcggcaaaggctgagaaagagtcgcccaccgcgccgtaggaagatgtgctgtacacccgctgctgcttcccattaaaaatatagatggaatcgatgatggtgctggaagccgagtaggtgttcagctcccgcacgccgtccaccacctgccagttggtgagctcctcgtaggagcgcagcttggagacggtgttgctgtaaaatatttgatttaccatattttggagaaattcctcggtcgaggaggaggtggcgctgacctggtatacaaattcctcattggcgcggttgatggaggacaggaatgccttctgaaattggtgatataatagcccgagaagcgctaaaatcaacacaaagctcatcagcacaaccgataaaaaccgtatggagattatatcctttcccgggctgctttttttcttccttttcatgattttgcacactcctttccacataaaaactatatcatatatgcaatatgtttgaaaagagcaaaaagatttgaaattcgaacatcggaaaaaaagtcatatttttgtactttacacaatatgggagacaaattaagatgggagcatacaggagctgacgctccaatgtgtttttaacgcgtttcagatactgtaaaccaagcgatataaacgaaaaaagggaagaagaaaggattgaatcgtatgaaaaagagacttgtatcaatcacgctggccacaacaatgttgttatccctgaccgcctgcggttccggaaattccggcggagcggcaggcaccgccgctcctgcggcgcccgaaaccgcggccgccggctctgaggccggctccgaagctggttcccaggccgccgcaggggcggaagattataaaggaaccgtgatgctctactcctccactgacgagggcgtgatcattgcattaaaagaagcgtttgaaaagaagtatcccaacgtaacgctggattattacgccgccacctccggcaagtgcgtgacaaagctggcaactgagttccagtccggcacagtggcctgcgacctggcctggctggcggacccctccgccatgatcaccctgaaggacgacgggaacctgctgtcttacaaatccccctatgccgaaggcatcgacggcaagttcaaggatgcggacggttattactgcggcgcccgcctgctgctcatgggcgtgaccttcagcaccgccacctgttccgatgaggaggctcccaccaattacgacggctttctgggcgagagcttcaaggatcagatcgtgatgaccgaccccaccggctccggctccaccaaggctctggtctacgcgctgacaaacgattcggactatggctgggaatattttgagaagttaaaggagcagggagttgagcttcagtccagctccggttccaccaacaacggcatcgcctccggcgcttacaagctgggcttcggcgtggactacaacaccaaaaacctgatggccgagggctcccccctgggctggcacgacaccaaggacatcgtggccgttccctgccccatcggaatccccaagggcgcgcctcaggaggaactggcccagcttctctatgactttatcctggatcccgagggcggacaggctattctgacccagtacaacatcacccccatcgtggacggcgtcgcccttcccgacggcatgatgaaggcctccgagatcgccaatctggccctacccatcgactgggtggacctggccgcggtcagcaacgagcttctggatcgttttgacgccatcttcaagaactaagccattgcagacgatgacccgcaggcagaacccgtgggtcatcgtattcaaaaaggaggacgccggcccgggaggcattttggagattgattcctgccggccgcgcgtcttttataaattgagtgaaaggggaatcgtacattgtctaaagtgagtatggaacatatccgcgttgcctacggcagccacacggttttaaaagatttttccctgaccgtggagccgggggagatcgtggggatcgtaggtccgtcgggctgcgggaaaaccaccgccatccgggcgctttgcggatttttaaaccctgagatgggggagattacggtcaacggcaggaaggtgttcagcaagaaggagcgcgtgaacgttccgccggaaaaccgcaagatcggcatcgttttccaggactacgcggtctggccccacatgagcgtttacgacaacgtggcctatccgctgaaaaaacggaaagtgcccaaagcagagattgcaaagcgggtcggctacgccctggagcagtcccacatgaccgggtatgagaattacatgccttcccagctctccggcggccagcagcagcgcgtggccatcgcccgggccctgacctcctcggacgacattatcgtcatggatgagccgattaccaacctggacgccaagctgagggaggagatgctggtggaaatccgcctcatgcagtcccggcttaacaccaccattatttacatcacccacgaccaggaggcggccatgcagctctgcgaccgcatcgtgatcatgcagaaggacgggagcatctgccagatcggcacggacgaagatatgatcaagaatccggccaaccgcttcgtgttcagcttcatcggcgtgtccaacttcatcccggtggccgagaaatccggttcctggtgcctggacatcggggagggcatcccttacagcgccgtccggccccaggggattctgccgggggtaaaaaatgtcatgggcatccgcccgatggatatcattttcgacgacgaaagccccgtgcggggcaccatcgagcagtccgtgttcctgggaagcctgtttaactacttcgtgcgggtgggagatcaggagctgcgggtgcagcggagcaccctggacagtctggacggcagggagtacgcggagggccaggaagtgggcctgcgtttcctgaatgagaagtattacgacgcagaggaggaaagtgtatgaacatgttcaagcgcaagacaaacagcgatttggagcggctggaaggcggcaagctgatgagcctggaccggttcatgaccctgctgtgctacctgatcctggtgacggtggtgattctgccggtatttatgatcatctactacgccttctgggacggaaccaagatcgatttccagatgttcttcaacgtcctcatgcagaaggaaaatttaaccgcaatgcgaaacaccctggtgatcgcggtgttttccacactgctggccacggcggtgggcgtgttcttcgcctggcttttgggccgaagcgacattccgcttaagggcgtgatgaagtttctcttctccatccccttcatgatcccgccgtttctggcggccatggcctgggatatgatgttctccggccgcggcggctatgtgaaccgttggctgatgtccgtgttcaacctgagcaaagcgccctttaacatcaacagcgtgctgggaattatcgtgatcgaggtggtttactacttccccttcgtctacatgcaggtggtcagcgccctggagcgcatggaccccacattggaggagagcgcgcgcatcgccggcgcaaagcagctctacgtgatccgcaagatcacgctgccgctgaccataccggccatttcctcaggcgtgctgctggttctcatcacctccctgtccaactacggcatccccgccatgctgggcttctcccagaacatttttacgctgccgaccatgatcgtggagaaaatgaaccgggcgggcggaagctttgagggcatccggcaggcgacggcattggcgatcgtcctggtggccgtggtgtccgtagcgcttctggtacagcgcaagctgctcacggtggggcgctacgatatcatcaagggcaagagcatgcgcccggccctcatcaagctgcgctccgcgaaatatccgctgctggtattttccctgctgtttttgaccctggtggtgctggctcccctggctatgatcgtgctggtgagctttatcaaggcgtacggactgaattttgcctttgaaaactttaccctggccaactaccaccgcatcctggtgggcaacaagatggttacggactccgtgggcaacagcctgttcctgggcttctccgcgggtatcatctgcctgtttttgggcaccatgctggcctacgtcatttacaaggtgcgcccgaagggcaagggcatcctggaacttttggccgtgctgccctactccctgcccggaacggtgctggccatcggctgtatcctggcctggagcggcgcatttatgggaatcactctctacaacaccatctggatcatcctggtggcctacgtggcgcggtatctgacctacacgttaaaatccagctccgcggcccttcagcaggtacatatctccctggaggaggcctcccgggcctgcggcgcgactcatctggagtccctgcgggatatcaccctgccgctcatcaagcccgccatggtatccggtttcttcctggtattcctgcccgcaatgcgcgagctgaccacctccgtgctgctctacgggcccaacagccggacattgggcgtggccatctaccagctgaggatcaacggccagatcgcccctgcggccgccctgtccgtgatcaccattttgctgattattatctgcaacaacgtcgtcaaacatttcacaaaggacagaaaggggagctaaagccatggatcaaatcgtactggaaaatgtcaccaagacgtttaccaccaaggcgctgggcgccgtcacggctgtgaaccgctttaatctgaaggtaaaggagggcgagtgtttttcctttctgggcccctccggctgcggcaagaccactacgctgcgcatgattgccggctttgaggacctctcctccggctccatctatctgggcggaaaggcggtgtccgtcaaggacaaaaatatctatatcccgccggaagaccgggggctgggtatggtgttccaggccttcgccgtctggccccacatgaacattttcgataatgtggcgtttccgcttaaggtacagaagcggcccgaggccgagattcgggagcgggtcgccctggccctgaagcactgcagcctggacggcatggaaaaggtgttcccctccgacctctccggcggccagcagcagcgcatcgccctggcccgtgctatcgtggtgaaccccaaggtcatgcttctggacgagccgttgtccaacttagacccgcagctgcgggagaccatgcgctttgagatcaaaaagctgcagaaagaattcggcttcaccatcattttcgtgacccacgaccagtccgaggctatggcgctctcagaccggatgctggtgatggatatgggaaatatccagcagatcggcacgcccctggagctttacaacaaccccaaaaaccggtttgtgcacagcttcctgggtcagtccaatttcacccacgtgaagatcaggggcggcaaagcttactgcgagggcgacagctcccgggtggtgtgggatgcccctgcgggcacaaaggacggggaaatgctcatggccacccgccccaacaccatcgatatcaaccgcagccagggatttcgcaccaaaatcatcaagcgggtgttccgcaccgattttgtggagtatctggtccaggtgggcggcgacgtcctgcgggtccagacaccccaccgcaacctcttttccgagggcgaggagtgcttcctgcgcttccccagccccatgtggtatcccgcccgggaggagggagccgatgaggagcgggcgaagcggatgatcgtataggctttggccggtttggaggttctaagccaacacctcaaaattcagcgtcccccgctccgtcccgttcacaatcagcgtaaccgagtgggggcccggataatgctttctcgtgctgacgtccgcaaaggaatgggttttcgtgtaagcctttttcgtatgttccttaaaagaaagctcggaaatctggaaaatcctgcggctttgcctgccgttcgctttccggtaatcgatgccgtactccagacgtaccttcgcagccgcttccgtctcaaccgtgaaggagaaggtcatttcctgcccgatggcaacagaggcggctcccagcgcaaagccgtaaacctttacgcggtcgggggccgcaaagccgaagaggtccatcacctcccggttgccctttttgagcagagtccggcagccgtgttttacaatccagtccgtgcgcgcatccctgccgtaccagtccttagcgatcccggcgaccagttcgggatgggttttggaaatgtcgttcaggttgttggctacgcttttgcggacgtagagcgacggatcggctttcagctgttccaggatacccagcaccggggacgggtcttttttgaagcggggcagcgcctggccccagggaagccgggggcggcagccctcgctggccagccgccggacgtgctcgttggcgtgtctggcccagacggacatctgctccatcatgcgcgcctcatgcctgatgataaacggcctcacggcgaactccgaggaggagaaaacggtgtaacgctccagcgcggccatggacaaatcccaatggcgctcatcctgcccgtagacttccacaaaatccgggaagcacatgagcgtaaagtcgttaaacccgtccggatatcccgcggccacctgatccagcacacccagggcctgttcgtaaccggcgggcagatagttccccagattcacggcgatctgccgcatgcgggcctttaactccagcgattcccacgtcccgtccatcacgctgcgcacaaaatcctcctcctgaaacggatgatatacagcctgaatccgccgggccagctcgcgaatcgtttcctcattatatttgtttttcagcaattccggcatatagttcccctttttagatgcatttggccgggccccccatggaacaatgcggcagaggatcccggaatggttgtcagattcccattgtccaaacatggacgtctgattttgattatatcgtagattgtccgcaaagacaaaagaaattcccgcattgcggcgcgaatgcgccgcaacgcgggaattttgttgaatgcaatgatccgctggcacagcctgcgggaatttgcggcaaccgcaaacactcaagttagaaaatattgtaaattcccacaaaggcaaacacaacgctcaccagcacgctgacaatggaggtcaaaaacagccggacaaacagcttgttggtgtcctggtcgcccttgtccccggtgaagatggcgtactgggccatgatgcctgcgccgccggtggaggcggggctgaacgcggccaggaaggaggtgatggtgatgctggtgatcaggggagcgtacccggcgccggggaactgctccaaaatgccggtgatggtggggatcagcgcgggcatcaccacgcccgtggtggagctgaaccagctcataacgccggccgccagcgccatgatgggctttgcggtggagccgctcatgatggaggtcaggccctccaccagaaggtcaatgccgcccagggctttgaccaccgccatcagcatgttcacgccgcagaccaggataaaggtgccccagggcatgatcctgatggcggccttgtcgcttgccacgccgaagatacacaggatgatggctgccagaggagccgcaaggccgatgttgacgccgaaggcgaataccacgaccaccacggccaggcaggccagaagggtcagcttctggttccggtcaaaggggtggacgtcgtctaacatggcaagctgttccgttcccggtttgtaaagtttatataggaagtaaaagcccagggtgaggagcagccataccagagcgcactctgcgaataaggaccaggagaactgtcccgcgtagggcgtctccgcgatcagtccggccgcgatgatgccaccgttggcaatgggggacatgcagcctaagttgcaggccagggtgatgatcaggcccatggcgatcacgtcgatgcccagttccacggccagggcgatgcccaggggaaggataatggagaaggtggggatgtttccgcagcctgctgccgccagaagaaacgtcatggcggagaggagcagcgggatacaccaggtgtttttgcccactatgcggagcatctttttggccaacaggtccatggtcccattgtttaccgccatgctgaacagaaatgcggggcctaccagcgagataaacaggctggtgctgaaattggagatcacggtcttgtccggtattccgccaagcctggcgatgatgagcgccatgcccatggccagaaagcccatattcacctttttccagaatcccagaaccagcacggcgacgagaaacagcagtgacagcaacgctaaactattcatatgtatacctcccaatttaggaagaggccgcgtccccgcgcggcgctcttttagctgaatggaacaggccgccggttaaaccggcgggcgatttgttcaaatcccgtccttaaaggccagggaatcaattttcgcgtcaaaatccagaatgcatcggttgaatttttccgcttccaaaagcgggaacaggtggtggttgcattccgtgaattcatagcagagggcaagcggagagcgggtcatgcggcgcaccgcctcgtggccggagtcccaggcgtcgtgataggacgagtgagagacaaatgccgccaccgggatggtccggttttccagaggagtcatgttgtccgtgaaataggtatccatgtggtattccacgcctacccacggcggaatctggagcatgctctcctgcatgttgtccgcgtcctcctgttccagcggggaggaggcccgggctttggctgcgtatgacacgggatcgttgatgtagggcatcatgcgctggtaccagccgtcgatattgtagtggttggccttgtggctgttccagtccgcgtcgctgaaggcgaacagggaagcgtccgcaaggatcatgccccggagcgcgtgttcctcctgggtgttggcgtaggtggccgccacggccccgcccagggagtggcccaccagaagcacgtcctgaaggcccagaaaatcgatcagttcccgcacgtcctgggccatgcggacctggcggttccccccgggaaccttcatggagcgcccgtggccccgcaggtccaggcacacgacctggtgggtgcgtgagagaaccgggacgctgtgacgccacatttttaaggattccccgaaaccgggcagaaacaaaatcggctttccgcagccgtgtatttcataataaagccataaaccgtcggatgtctgaaaaaaattgtcttttgtagccaaataatccccctccaaactgttgtgtgatgaatacttaagttgtaaagagccgcgacacttcgtttactattccaatatatcatgtgggtatttggaaagcaaattcatatttgctataaaaattatgaattttgaccatgattttgtgatctggctccatgaaaatccccctccgtacatttgtactccggagggggattttctggtttatgtaaaatcttttacgatcttaatatactcctgggcatgatacgggagatagctgcccttgcggtaggcggcgacaaagtctaccgtggtgttgggagttcccacggaaaagcagcggaccggctgcttcagacggatatgctttaagtgagtctcacagacaaaggacaggccgtagcgcttgctgaccagctccgcgcctgcgctgatgttgcgggtctgcaatttgatgtggggctggattttatattctttaaagaggcggttcacgatctgccgtgtgcgctgctcgggcagctgcacgatgaagggctcgccggccgcccggcgcaggtcgaaccagggatagcggcagttctcccgttcctcgcccagttcggccaggggatggtcctcgggcatgatcaggacgatctcctcgtggctgataatctgccattcgatgtccgggctttttaccggcaggttgaaaaacgccaggtccgtctccccgctgaggatcatggactccagcacgccggaattctcctccatgatatccaggtgcacgttggggtataagctgttgaagatcggaagggtgcagggcagcatataggtgccgcgcatgaccgggaaggccaccttcagcacgcccacgttggaacacacgatatcgttcatctcctggtccagctccttcttgatattgagaatctccgtggccttggcgacgtagcgctgcccggcgtaggtcagggtgaatttgttgcccagcttcttgaacagcttctggcccatgtccgcctccagatgctggatgaacttggtcagggtcggctgggtgatatacagggagtccgccgccttggtgatattctgatattttgccactgcaataatataggtcagatctttaaaatccatttccaattccccctcacagagatatgtattcttccggtgcagtaatagaggccctccgctccaaaccgggacgttaaaatcatcataccacaaactatggcaaaaaaccataatttttatgaaaaatatgaattagacttatgggaaggaaggggctataatgagcccatacaagacggatcgattccttgcaattaaaaaatacatagaggcagccgccggaaccggcgaaatgaatccggtgaaatggacccggtaacatgaacccggcagcagcctgtctgagaagaaagaaatgtttgaggaggtaaggtatgaatttatgaagtgttgtcggtagtatttctgtttgcggtcgttgcgctggggttctggcgcaagtgcaacatcggtatcctggcggtgggtttttcactgattatcggaaagatcggcgggatgtccaattcccagattctgggtggctttgacgcgaaactctttatcaccctggtcggcgtcacgttcctgttcggcatcgcccaaagcaacggcacgctggagctgatcgccaagcgggcggttgggctggccggaaaccgcccctatctggtgccggtgattctcttcctggtgaccggccttctgtcggccatcggccccggaaatattccggttggagccctgatgacggttgtagcggtcaccatcgcggtggagatgggggagaatcctctgctgttcgccctggcggccaaggttgcggccaacggcttcaccatcacgcccttagctccggcgggcgttttgaccatgtccctgtcggagacggccgggtataccgacatcattatgccggttatgcttaacgtcatgttgtgggccgtgatcatgatggttggattttccattcattataagatataccgcatcaaacccggcgctgtggctgtgggcggcgcggtcagcgagaaaaaaccggtcacccgggatcagtggatcacaatcgttggcatgtgcgttatggtttaccttgtcatgttccgccgcctggacgtgggcctcacctccttcttcgtagcggctgtgctgattctcctgggcgttgccaaagagaaacaggctctggccaagatcccctggggaaccctgcttctgatctgcggcgttggcgttttgatgaatgttgtaattgaaatgggcggcatcgacctgatctccgaagcgctgctggcgatcatgacccctgctaccgcggctccgatcatcgcgttcatttcctcgatcctgtcgttcttcagcagcaccaccggcgtggtgatcccgaccatggtccccaccatcggaaccatcgtggattccctgggaacgggaagcgccggatttatcagcctgaccagcgtgatgatttcctcctccctgtcctccgcgttcagccccgcatccaccggcggcggcctgatcctggcggcttacatggctgcctccaattcggagaataaggagcaggagcagcagaagctgttcggacgtctgtttatgattgccattgcctgcgtaatcgctaacattatcctgtcggctgtgggcgtatacggaattatcaaataagggaggaaacggaaaatggacagagcaaacgcagttccctgcaccgtgatgcggggaggcaccagtaaaggactgtattttttaaagaaggatctgccggaggatgggcagcagcgggatgcgctgctcatgcggatcatgggaagcccggatcccaagcagatcgacggcctgggcggagccgcctccgtgaccagcaaggtggccatcgtctccaggtcggagcggcccggagtggacgtggattacacctttgcccaggtggccgtggataagccgttggtcagctacaagggcaactgcggcaacatttcatccggcgtcggtcccttcgccctggagaagggattggtcaatcccaaagagccggtgactaccgtgcggatttacaataccaacacggataaggtgatcgaggcccaggtccaggtggagaacggcagggtgaaatacgacggagactttgccattgcaggcgtgccggggacggcggctcccatcaagctgagcttcatcgaccccatgggttccgtgaccggaaagctgctccccacgggaaatgcctcggatgtgttggatatccccggcttcggccaggtggaggtctccatcgtggacgccgccaacccgctggtatttgtgcccgcggcggccgtgggactgtcggggaccgagcttccggcgcagattgacggaaatccggaaatgctgcggctcctggagacggtgagaggggctgcggccttaaaactgggatttgtttccagtatcgagcgctccgcctgggaaagtccggcggtgcccaagatgaccatcgtggcggagcccaaggattacgaggcaacttccggcgcggctatcagccgggatcagatcgacctgacggcccggatgatgtccatgcagaaaacccatcccacctacgcaatgaccggagccatgtgcaccgcggcggcggccgtgatcccgggaaccgtggtcaaccgcgccctgagagcggatgcggacccggaacggctgcgtattggccatccgggcggaattctggaagcgggagtggaatttgaacctgagaacggctcggtccgcatcgtcaaaacctctggttacaggaccgcgcaccttctgatggaagggaaaacatacggttaaaaaaattttaaaaaatgccgaatagagagctgaaagttagacatactaaccgtgtaaccaaaaaagctttttaggaggtaaaaaaatgaacaacagaaataacttcaacaacgacgctgagaattacagcagccagaacagctcccagaacagcagccgcaacaattctcagaacagctctcagaacaacagccagaacagttctcagaactcctctcagaacagcagccgcaacagttctcagaactcttctcagaacagcagccgcaacaactctcagaacagctctcagaacagcagccgcaactgttctcagaacaacgagcgctaattatagcggattattcctgcggttttcaatcgagaacacgatgagcagaacccggtttgtgatgaacgtcacagaccgggttttttagctgcgcccggggctgccgtccgggtccggcggcgttctcacgctccggggacaggtctcatataatgatagtagtacatggcctgtctcggatgtccgggccggaaaggatggaataatatggaatttccaatgatatcatacagagaactggatcagtggctggaacagggaggcgcctttttgctggtggacttaagggaaccgttccagtacggcagggaacggatctggggcagcataaacattccctacgaggagttggaacagcgccttaacgagctgccgaaggactacaccctggtattttactgtgaccggggagccaagagcatgctggcctgccgggatctgggaagaatgggttaccgctgtgtggatctggctggaggaatgctttattaccggggaaaattcattgacagaagggccccaggggctatagaatagagaggtgaaaaatacgggaaaagaggagaaaccgcatgaaactcatgtttgcatccgatatacacggctccgccttctactgcaggcggatgctggaactctataaaaattcgggggccaagcgcctggtgttgctgggcgacattctgtaccacggcccgaggaacgacctccccagggagtatgcgcccaaggaggtcatcgccatgttaaatccccttaaagatgaacttctggcggtgcgcggaaactgcgacaccgaggtggaccagatggtgctggagttcccgattctggcggactacggtctcctgctggtgggggaaacgcgcctctacgccacccacggccatgtgtacaacgagaaccatctgccgcccttaacggacggggacgcgctgatccacggccacacccacctgctggaggccaaggaaatcaccgcagaggacgggaggcgcataaagatactcaaccccggctccgtgtccattcccaaaggcgggaatccggccacctatgcgctgctggaggacggagtgtttacgattttgaccctggacggggatgttgtcaggcagatcagcctgtagagaaagagtgaggaacgaagattgaaacgtacatttgaactgattgccccatgccatttcggcctggaggctgtgttgaagaaagagatactggacctgggttatgagatttccctggtggaggacggcagagtgacctttatcggcgacgaggaagccgtttgccgggccaacgtgtttttgcgcacggcggagcgtgtgctcttaaaggtggggtcctttgaggccagaacctttgaggagctgttccaggggacccgggagattccgtgggaggagtatattccccaggatggaaaattctgggttgccaaggcgtcctccatcaagagcaagctgttcagcccatcggatatccagtccattatgaaaaaggccatggtggagcggatgaagggccattacaacgtgacctggttcccggaggacggggccagctttccgctgcgcgttttcctgtataaggacgtggtgaccgtcggcatcgacaccagcggcgactccctgcacaagcggggctaccgcaccctgacggccaaggcccccatcacggagactctggccgctgcgctgatccttctgacgccctggaaccgggaccggattctggtagaccccttctgcggcagcggaacctttcccatcgaggcggccatgatggcggccaacatggctcccggcatgaaccgttcctttctggcggaggactggaagagcctggtgccgcgcaagttctggtacgaggtcatggacgaggcgaacgatctggtggagcaggacgtgaaggtggatatccagggctatgacatagacggcgacattgtgaaggcggccagggccaacgcggcccaggcgggggtggaccacatgatccatttccaggagcggccggtgagcgctctgagccaccccaaaaagtacgggtttgtgatttccaatcccccttacggcgagcgccttgaggacaaagccagccttccggcgctgtaccgggagatcggggagcgttaccgtgcattggacgcctggtccatgtatctgatcacgtcctacgaggatgcggagaaatacatcgggcggaaggcggacaaaaaccgcaagatttataacgggatgctgaagacctatttttatcagtttatgggacccagacctcccagacgaaatcaggagaaccggaccattgagacagaaacagaatagaaggaaacgcaggagacgccccctgtatctggccctggccctgagcctgggactgacggcggggtgcagccgttggcagccggacggcggcagcggcgcgcaggcacagcaggacggcggcgcgggaagcggatatgcggacggcggcgggaagggcacaggcggcgtggcggacggagtggccggtggcggaaacggtgcggcggacggcggaaatagtgcggcggacggcggaaacggagcgggaagcggcggaaacagtgcagcggacggcggaaacggtgcggcggacggcggaagcggtgcgaacggtggaaacggtgcggcggatggcggaaacagtgcagccaacggcggaaacggtacaggcggcggcgttaacggcgcggtaggcggagggaacggcacaggaagtggtgcggcaggcggcggaaacggcaccggcggcaaatcagccgcctcctcagacggtcaatccccctgtgcggagatcatccaccgggaccaggaggcgcagagcggcggcggagatgtgaagctgccgtccgcctacgactaccgaaagacgggccgggcgcctcagatcggcaaccaggggtccctggggacctgctgggcgttcgcatccttaaaagcgctggagtcctccctgctcccgggcaagtccctggaactgtccgtggatcacatgacgttgcacaacagcttttccatgtcccaggacgcgggcggggagtataccatgtccatggcctacctgctggcctggcagggcccggtgctggagtcggaggacccttacggggacggctactccccggacggcttaaagccctgccttcacgtgcaggacattcagattctgccggccaaggactatgaggccatcaagcaggccgtgtaccgttacgggggcgttcagagttccctctacacctccatgcgcaactaccagagcgagtcagtgtattacaaccgcacgacaaactcctactgttacatcggcgacgagaagcccaaccacgattccgtgatcatcggctgggacgacaactactccaaggacaatttcaatatgggcctggagggggacggggcgttcatctgtaccaacagctggggcgaggatttcggagaccagggatatttttatgtctcctactacgacaccaacatcggcgtgcacaacatcgtgtacacgggcgtggagccggcggataactatgatcacaattaccagagcgatttgtgcggctgggtgggtcagatcggctacggccgggacagcgcctggtttgccaacgcatacaccgccggaaaaggggagaacctggaggcggcgggattttacgccacggaccagaacacggactacgaactatacgtggccagacatctgggggagaaggctgaccaaaccttcggacagcgggtgaaggtggcggagggacggctgcgctacgccggtttttacaccataccgctggatcaaaaaatagtattggatgacggcgaaaaatttgctataatagtgaaaataacaactccgggaaccgttcaccccgtggcgatagagtacgacgccggggacgggatggccgagattgatttgagcgacggagaggggtatctgagctttgacggcgacaaatgggagcacgttgaggaaactcagaagtgcaatgtctgcctgaaggcctacacctccaaccgatagaaagcaggaatataccatatggaagataaaattgtttttgctaccggaaacgaagggaaaatgcgggaaatccgcagcattttatccgatctgggactgccggtgctctccatgaaggaggccggcgtttccccggagatcgaggagaacgggactaccttcggcgagaacgccgagatcaaggccagggccgtctgggagcagaccggcggcatcgttctggccgacgattccggtctggtggtggactatctgggcggcgagcccggcatttactccgcccgttatctgggcgaggacacctcctacgaggtgaagaaccgaaccattatcgaccggctgagggaggcacgggaagaggagcgcagcgcccgttttgtctgcaacatcgcggcggtgctgccggacgggagcgtgctgcacaccgaggagaccatggaggggagaatcgccggggaacctgcggggagcggcggattcggctatgatcccattttgtggcttcctgagtttggaaagacatcggcggagattaccatggatgagaaaaaccggatcagtcaccgcggcaaggcgctgcgggccatgagggaagcgttggttaactggctgggaaaggataagggatgaagatactgatagtgagcgatacccatcgcaaggacgtgaatctgagggaaatactggagcgcagcggccggctggatatgctgatccacttaggtgatgcggaggggagcgagcaggagatcgcctcctgggtcaacgagggctgcgatctggaatttgtgctgggaaacaacgactttttctccaatctggaccgggaaaaggatatcatgatcggccgttaccgggtgctgctgacccacggccactattacagcgtgtccctggggccggagcgcctgatcaaggaggcgcgggccggcggatttgacatcgtcatgtacggccacacccaccgtccgttttacgaggtggacaaaaaggacggggacaaggacctgatcgttctgaatccgggcagcctttcctacccccgccaggacggacaccgcccgtcctatatgctgatggacatcgaccgggacggggaggcccatttctcgctgaattatctggagaggtgaaggttccttggccggaggtggctgcggaaaaagaaggtttttaattgaagaaacatgcttggcaaacatatgtttataagttaaaatattcatagggaacaatcatgttattacaaggtgttggccttccattttacataagatgggaggtggtgcgaatgaaatttgatttcaaagacttaatggcctttggtatgttcattctcgcattgctgacctttatcttaaagattagtcagtagcgtttttcaagtcccagaaatgggcatagaaaaaccacccttgtatacttggccgttgcgagggtggaatttctatcttagttatgggccaacctcttgtgtgaggtggttgttccttttttattacatctatattataatcaatccatttctgaaattcaagcaattttaagaaaaactctttgatgattttgcttgaacgcggaggtggctgcggaaaaatactgcggaaaaatatttgaaatccggttgacaagagcgaaggcatggtatataataatttttgcgtcgcgagacggggaaatacaggtataccttgcctgacaccggggtgtggctcagcttggctagagcgcctggtttgggaccaggaagtcgcaggttcgaatcctgtcaccccgacttgaagatatgcaggtgtagttcaatggtagaacactagccttccaagctagatacgtgggttcgattcccatcacctgctcttataaaaaactgggaaaccttgtgatagcgaggtttcccgttttttttgctgtttttatggggtagatcggaggaaaaacgggatagagcttcaaaaaagactacagcccggatttttccagatcctgtatttccttcttttggtaggccatcaggctgaacgacgccccaagaacgccggtgcacaggaacatgaccgccatgccgcttccatttcccaatcccaccagctgtccaagggccgcggccgcgccggagccggactgcatgaacggctcaaacacgaagtcggccaggtagccgcccaacagaagcccggccgggattgtgcagtattggatcgcattccgcacggaaaatacgcttccctggagttcccgtggaaccatccgatacaggatcatcctctgtccggctgccagaaacggaatgggcaggctggcccacaccgcggcaaggctccaccagacggcgttttttcccagacccatcatcagatcgcccaggagaaaggacgctgcggctgagaagtagatcaattttacgctgctggctttaaacggcctgagcgagatgatgagtccgcccagaatgccgccggcgcccaggaccatgttgacggccccgagggtcaggctgttgccaccgctcctggccagaatcatgggggacaggatattttcgtacgtcaggcgggagaagaaattcagcaccgccatggtgacgatgatgtaccacagccctttgtggcggaacaggaaccggaagccgtcaaaacagccggacaggacggaagttcccctgggcgctttggataaatcctccggtattttgataaagatcagaagcagcgcaaaattaaacaaaaaggacaaaagatccgcggcgatcaccgcgcccagaccgccgaaggcgaagacggaggaggccagcaccggcgaaaccacggaaaccaggttggcggagaacgagtccatgccgctcatccgggcgattttgtccttgggcaccagaattcccaccgccaccgactgagccggtatctgaaaggaattcataaatccgatcacgcagttaaccgcataaatgtactggattttcagctccccggaccgccagcacagcaggacaaaaaatgaacaggcggccgcgatggaatccgctgcgagcataatggttttcttgcggtgccggtccacaaaaccgccggcaaacaggctgaccagaatgtaaggcaggtagttgcagaaggacatcagggacacggccattgcggatttcgtctgggtgtaggtccacaggatcaatgcaaaactggtcatggcgctcccaagctgggagacggagccgccgaaccagaataacagatatttcttaaaactattttccattgaagtttctctccttacagaatcattttttcggttccataagtacaaaacccaatgcgggcaaaaccgccgtttgctctgtacaaattatgcccgtgcaatggattttgtacagagatatctgcccatatcggtatatgacattgcgttcacctcccgtaccgtcagctctgtttggctgcggctgtatttctttgttgtaccatacccgaccggtaaagtcaatttatacaggacccagggcggggccgggcggcactcgtgcaacagtaagggggccgggagtctcgttgtctgaaaaataaggccctcaggcatgaaaattgcagcttaaaaaaaatataaaaaagagcttgcaatcgtcaaaaaagtatgatagactataacacgttgacacgacagaagtgtgtaccgctgtgggtaagaacttcggacaagtgccaggcgacggttgagtccctcgggaggctgccgggattgagtctgtagctcagttggatagagcaacggccttctaagccgtgggtcgggggttcgaatcccttcaggctcgttcggacgagagtccgtacaatttaatatggtgggtatggcgaagttggttatcgcgccagattgtggctctggaggcccagggttcgaatccctgtactcaccctttgagataccttaccggtagacggtaaggtatttttttgcgtatttccttgacaaaccaatctgtaacagttataattacagtataaactgtatctaaaatagtaacagattggcggcaaagaaaggaaaggactgtatgaatacaaaagagcacgcagagatgaagatcaggggtagcgcggatgtgtcttacctggggagaactgtggatgaaatgatctgggagtttatggaggaaaatggaattccaggcctgacactggccattgtacaggctccctatatcccgcgggtagtaggatacgggctgtccgacgaaaagcagcggcggctggcttccgtcaataccatgtggccggccggtcccatttcccaggcatacgcggcagtggcggccatgcagctgtacgaggcgggaaagctggatttggacgcgcctgtctcgcagtatgtggaaaatctgcccccgcggtggaaggggatcacgtcccgccagctcctgcgccacgcagccggtctggcggattaccggcaggcggagggctacgattcgcagagagagtgggactttgccggtctggcggccctggtgggggagaagaagctgagctttgagccgggcacaggggttgaacagagcgcaaccaatttcctgttgctgacagaggtggtcggcagggtctccggaatggactacgagagctttgtcaagaaacatcagtttgagcgtttgggattgcgtcacaccggatttaccggcgatctggatcaatatgacagcgaggatgtatctcagaccggcaatatccatcagcttttcaaaatggacgggcgttttatcgacccggtggagcaggccgccagttacaggcaggatggcagcccttacagcgtgattccctctacggccctcagaggcttcggggacgtctgggcctcggcgcaggatatttccttttgggatatcgggctggccgggggagtgctcatcgaaaaagcggaaaaccgggcgcagctctacgggccgtggaagcttccggacggaaatagcgtgcccgccaacgcaggctggcagttctatcaccaccgcggtttaatggatatcaaaggctcagttccgggattttcctcatttttgagtcgttttacccatccagacgagctggtctgcgtgactctgatggcgaaccgggagggggtggatttcacgaatctgggcagaaggatcgccggggcgttcggggacctgctgtccaccaactacgacgacaaccgcctgttcctgctggaagggcagtatccggtcgaagagaccctgcggcggctggaaatggggctcgagaaacggaatattcccgtgtttgcaaagtttgaccatggccaaaatgccctggaggccggtcttgagcttcgccccaccaccgtgctggtgtttggttcccctaaggtcggcacagggctaatgcaggcggatcagagcatttccctggagctgccgctgcgaatatccgtgtgggaggacgagtcgggcagtacctggctggccgcgcccaggatgaaacgtgcggcagcggagtatgggctggaaaatcattcggcggtcgccggtatgcagcggcttgtggagacgctgatccgggaggcggcgaatgtttatggagcgtaatttgtatgccaggtgcaacgtgtctggcgaggcgtaatgcgtctgccggcggcggaccttaaagtgcggagcacaggttatcggccgccggccggaaaatgcgcggcaatgggctggcggcgtagggagagaagccttgggaagcggatggattttcgctgttgaaatggacatgcggtttaaaagtccaggctgaaacggggcttgccaagcggcggattctatggtattatgtttgggtatgccggtggaatttcggctgatgggccatcgccaagcggtaaggcacaggactttgactcctgcattcgagggttcgaatcccgctggcccagcgatgaaaaaggttctgagaacgattgttttcagaaccttttttgcgtgtgactgcggaaaaaatatctatgtccgaaaatggcgggatttttctgtccgatctgttataatgaattcaggaaacccctctcttttcaaacgcccgcatgtgcccgcaaggcaccatgacagacaggaggaaccgctatgacaatcgacaaccacgccgcctgttacgcggcatttcaatcaaaagattcccgttttgacggacattttttcgtgggagtgacctccacggggatttactgccggcctgtgtgccgggcgcgtctgcccaggccggaaaactgcaccttttttaaaaccgccgcggaggcggagcgggcgggctttcggccctgtctgctgtgccgcccggaactggcgcccggctgcgcgccgatggtcccggcaacccggctccggacgtgcagcgctgtcccgcagacagggaccgtctgcgccccggtggacgcctcccaccgtctggcggttctggcggcaaaacagctggaggaacattgcgggagcattgagagcctggaggagctggcggcgtccctgggctgcacggcccggcacctgcgccgggtgttccgggaggagtaccgtgtctcaccggtggaatacctgcagacctgccgcctgctgctggccaaaagcctgctgacagataccgggctttcggttctggaggcggccatggcctccggtttcggaagtctgcgccggtttaacgccctgtttcaggcgcgttaccacctctcaccgacgtcgctgcgcaggcagaccggcggggccgtaaaacaggagggacagggcatatccctgtttctgggataccgtccaccctatggctgggaccgcctgctcgcgttcctggcgttaagggcaattcccggcgtggaggcggtccgggaaaacgcctactacaggaccgtgcggcttgtaaagcgggacggggccgaagtgtgcggctggatcaaggcggaaaatatgccaggccaaaacgcgcttcgcgttaccgtgtccgcgtcccttttagcggtgctgccccagacgctggcgcgggtgaaggagctgttcgatttgagctgtgatcccaaccggatctgtgagaccttacagacaatggatgcgctaaagccaggcttatgtgcgcccggcgtccgggtgcccgggtgctttgacccctttgaaatggcggtccggacaattctggggcagcagattaccgtcaagggagcgacgacgctggccgggcggattgcgcgggaactgggaactccgatccgcacggaggtggacggcctgactcatgtatttcccaccgcccaggacatctgcaggcttgaggagccggtttccgccaggttgggaccgctggggatgatcgccgcccggtccaataccatctccgcccttgcggggaagctgtcagacggtttcatccggctggccgcgggagcggacccggagcggacggcggcgcagctgatggaaattccgggcatcggcgcctggaccgcccattatatggtcatgcgggcattgggctggaccgatgcatttctggagacggactacggcatcaaaaaggccctggcgccccggaagggaaaagaaatcctggcgctggccgagagctggcggccctggcgcagctatgccatgatgaatttgtggaattcactgtaaaataggattcaggaggaacgttatgtactatgagatgaaatacgactccccggtggggcggctcaccatagcaagcgatggttcaaacctggcgggcctgtggatggaggggcaaaaatacttcggaggcactgtgaccggggagctgcatccttgcggggagctgccggtattttcccggacaaaggactggctcgaccggtatttttccggaaaaaggccggagccgtcggagctgccgctggcgcccatcggcggagaattccgccggacggtgtgggaactgctctgtgaaatcccctacggagagcttaccacctacgggcagatcgccagggacgcggcaaagcggcttcaccgggagagcatgtccgcccaggcggtgggcggggcggtgggccacaatcccatctcgatcataatcccctgccaccgggtggtggggaccggcggcagtctgaccgggtatgccggggggattgacaaaaagatttggctgctgaaacacgaaggcgtgaaaatggacggtctgaccgttccggcaagggggacggcgctgtaacgggaaatttatgatattttcataaataaaccagaaagcatccatagaatagacacatctttccgctatgctgaaagccaatgcgaaaaaacggaatgagttttgattcgcgaaatgaagagtgcggggaaatggatatgaccaacgaacagtattacgacctgatacggccgtacgaggacgccagaaggcttttggagacgcgtttggaaatcctgaaccacagcctttatggcagcagggcggtgtgcggtcccatccacaatatgcagagccggatcaaggccaagaagagcatcgaggacaagcttaagcgtctgggacagagggacggcgtgaccaatgccagggattacctccaggacattgcgggcatccgggtgatctgttattttgtggacgatatttataacgttgcggcggggttaaaacggcagtcggacctggttctggtgaaggagcgggattatatcgccacccccaagcccaacggctaccgcagctatcatatcgtgctgggagcgcctgtatactgcctggatgccatggaatattttcccgtggaggtccagttcaggaccatgtccatggatttctgggccagcatggagcaccggatctgttataaaaagaacccggagcaccgggaacggctggagcaggaatttttaacgtatgcggcggtgttaaaagagatcgaggaaaagttcgaggaacaccgggaacgccgggagagcggtgggcctttggaggaggcagattaaaaagaaattacacggcgccgggactgtttggaccggcgggagaggagaataacggtatggaaatggcgagacagcacgtgattgtggacgacgaggtgattgaatccggcgagattcaggagatgatccagccgctctggtggagcgtgagtatttacgacggggaggagcagtaccagcgggacctggagggttttaccgccccgcagcggtatctgttcgccctgcaatggtatttggctgaggtcaacaacggcgggcacgatcagttttactccaattccacgggcatcgtctgggaggacgccatgaacggagccagggagatggggatggaggagctgtacgggatcatccgggagtcggcggaccgcatgggcggagaacccgccaaggagcgggaggaccgctgggatcagatgagcgagcgggagccggattttggagatttgaataaaaggctttacgccatggaagatattgagcagcggatggcggcctatgctcttgagaaccggcaggccctgtattttgacggggaggtggagatgccggtgtttgaggactgaccgggaggagacgtccgaaaaaacgccccggctgcggagggaatgggcagccgggcgtttttggcgggaatgaattttcaaacgcgcctcagtgtgcggacaggacttcgtccaggttcagggtgcggcggccgtcctcaaagacgaagcaggggatgccgatgccgccgtttttgcggaccgcctcgtacagtggatcggattcacgcacggataagtaggcttttaaatccggcagggaagcggagagattcttgaagtcaacgtcaattcctgcctcgcgcagcttgcagagcgcaagcagggtgtcagggcagagatggcttccaattacagtgatattcatggggattcctccttgtaagtgttcgtgtgtggtttctgcactcagtatatcaggcatttacaattctgtaaaattgaaatatattataaagagattcgaaaatttcgataccaaaaaagggagaggaaaatggagctgcgcaatctgaatacatttgtcagggccgtggatgcggggagcttttccagggcggcctctgagcttggttatacccagtccacggtgacggcgcagattcaggggctggaggaggagctgggggtacagctgtttgaccggctgcccaaaggcattacgctcaccaggccgggggaagtgcttttgaagcatgcccggagcctgcttctggaagcggaaaatgcccggctggctgtcaaaagccagagggagccgtcgggtaagctgcggatcggcgcattttcgtcgctttgcaccgcgtttttgccggatcttctgagacagtaccaccagttgtaccccaaggtggacctggtggttcgcagcgggggcatcgaggcgctccgggatatgcttggctccggccggctggatttcgcatgggtgattgcggattggaaggagagaagcccgtggcgggctttttgcggcatgtcccatcccatctgggctgtggctgctcccggcagatacggccctggaaaaatacttccggcaagcggacttgaggacgttacctttcttttgacggaaccgggctgcccgtaccgccgtcagtttgagctgttctgcagcaaaaacgggatcgtgccccatgtgctgatggaggcggacagcatcgaggggatacgcaccttcgcccggtcgggtctgggggttggcatcctgccggatttcgccgtccggtccatggtgcaggaaggggctttggagcgtgtgatgatcgaggggttcaccccggcggtggagagcgcgctgttctgccatccggtgaagtggatgacgcccgccatggaggcgtttttgcagctgtccggggcgcaggagagggaggattagcaaaaaactcaaaaaatcattagaaatcagaagaaatttctgatagaatagaaatagaaacaataagtctcagaaagtatggcccgagccgtttggcgtcgggcctgctgtatgggtggatccgatgatggaggttgagcggatggagtcgttggtaaatgaagaagtgaaacatttgaaattcggcagaggcagtatagtagaggaaccggcggagcatattaaagtacggtttcagagcggaggcgctgtcaaaacctttcgttttccggatgcgttcgccggttatctggcgtttgaaaagggcgagctgcagaaaaaatacaacgagatggcaatgagcgagcgcaggcgcagggagacgggacaccgggaagaaatcctccggatggaggaggagcgcaaggcggcgcagttggaactgctgaaacaccgcagaagcgccgcccggacggcgaaaaccgtggcaggaaccgccgctaagaagacaaaatagaattttttgcgccggttatgggcagcgggcggggatcgagccccggctttccgcaaaatttccggcgcgacggatatggcaggtgttaaatgatcaagagcgcattttccgcctcggacaatcagacattataccggaaccagatgaaacttttgatccagaccggctgcaagtatagctgccgggtgacggtggatctggcgggacgcaggttcaacgccaaaagcatgatgcacatcggcgacatcaaggccggggaccggtttgaactattgtttgacggcgaggacgagatccgtgccctggaggaatattccagagttttggagacagattgagaaagagatatcaaatgaaaatcatgagattctttcgatgggaatgggacaacgcatggagagcggcgaatttggaccggtaaacatgcgacagtgaatttggaacagaatgacggggcggcttgcagaggtgcggagccgccctgtttttatggggcggcggtgcgatgacgcggcggcggccgcactctcccgggattccggttgaatcccggggggatttacactataatgatacaataaacggaacatcagagtatttacagaaactgtaaggagtgtcggagttatgaaatcattggttatagcggaaaaaccctccgtggcccgggatatcgcccgggtgttaaagtgcggcagacagatcaacggcgccatcgagggcggcgcctacatcgtcacctgggggctgggacatctggtggagctggcggacccggaggcctacgatcccaaatacaaggagtggaagatggaggacctgcccatgatgccggagcccttcaagctggaggtgatccggcagaccaccaaacaatatcaggccgtaaaggcgcagattcaccggaaggacgtgggggagatcattatcgccacggatgcggggcgggagggcgagctggtggcccggctgatcttaaaaaaggccggcagccagaaaccgttaaaacggctgtggatctcgtcggtcaccgacaaggccatccgggagggatttgccaatttaaaggacggcagggattatgaaaatctctacgacgcggcgatgtgcagggcggaggcagactggctggtgggcatcaatgccacccgcgctctgacctgcaagtacaacgcccagctctcctgcggccgggtgcagacgccgactctggccatgatcgccaggcgggaggaggaaatccgcaagtttgtcccccagccctattatggaatccaggcaaaatgcgcctcccccgcgctgacgctcacctggcaggacggggagacaaaaagcttccgctcctttgaccgcgcccgcatggaccgggtgctgagcgcgctccagggagcggcaggaggaaccggcgtggtggcggaggtcaggcgcacgccgaagaaaacccaggcaccccttctctacgacctgacggaattacagcgggacgccaacaagcggttcaactattccgccaaggagacgctcaatatcatgcagcgcctgtacgagaaccacaaggtgcttacttacccgcggacggactcgcgctatctgagcgcggacattgtgcccaccttaaaggaacggctgaaagcctgcggcgtgggcccctacaagctggcggcaggacgccttgtggcccgtccgctgccggagaagctgttctttgtggataacagcaaggtgtcggaccaccacgccatcattcccacggagcagtttgtgcagttggatcacatgaccgtggacgaacggcggatttatgacctggtggtgcgccggttcctggccgtgctgtacccgccctacgagtacgagcagacgaatctgacggtgaaggcaggcggggaacgcttcgtggcccacgggaacattgtgcgcagtcagggctggaaagcggcttacgaggacggatatgatggggacgaggaggaggatcaggaggtgaaggggcagcggctgccggatttaaaacccggggacgtactgaaccggctgacatttggtttgaccgagggaaagaccaagccgcccgcgcatttcaacgaggccacgctgctgtccgccatggagaatccggcggcttacatggaatccggggacaaggagatggcccggaccctgggggagaccggaggtctgggaacggtggcaacccgggcggacattattgaaaagctgttttccagttttctgctggagaaacggggcaaggacattcttctgacttccaaggcgaaacagcttttggagctggtgccggaggatttaaaaaagccggagctgaccgcggactgggagatgaaactgtcaaaaatttccaaaggttctctgaaacggacggcctttatgagcgatatccgcagctattcccgggaactgatcggacagatcaaatccggcgaaggccagttccgccacgacaatctgacgaataccaaatgtccggtgtgcggcaagaaaatgctcctggtaaaggggaagaacagcgagatgctggtctgccaggaccgggagtgcggccatcgggagaccctttctcggaccagcaacgcccgctgcccggtgtgccacaagaaaatggagctgaaaggcaaaggggacggccaggtctttgtctgcaggtgcgggtacaaggaaaagctgaaggccttccaggagcggagaaaaaaggagggggcgggcgtcaccaagcgggacgtggccaaatatctgaatcagcagagcaaggagacggaggagccgctcaacgatgcgttcgcccggatgctggcggggatcaagctggaccagtgacggagggaggcgggaaacgcgggttttactcccccttccctgcctccatctccagcatattgcggaaaagcttatcccattccggataagaccgctttaaggatacgggacggccgtccagtgtgaggaagcagtgggcgctctccgcccgggtgcgcagttccccggaggagacgtcgcgcatctcgtagccgatggtcatgcggatgccgttgtactccttgatccaggcgtggatgcgcacggtgtcgccgaagcggaccatgcttttgtatctgcagtttacttccagaacggggctgcacacgccggcttcctccatggcccggtaaccgcagcccatctgatccatcaggtccacccgggcctcctccatccagcgtatatagttggaatggtgcacgcagcccatctggtccgtctcgtaatattttgcgttgtgttcatagtcctttaacatggtgtttcctcccgaacaaatctgataatggcaagtatagcgcaaagtcatccgccgcgcaagtgccggtccgcgcagacggccatccggaggacgattttccacgatgaattgattattaaaaagaaaaaaatataagtattgacagaaaatttttattcaagtagtcttgtatcaagagctggcgccatctctcaatacaatataaggagagaacattttatgaatcattcaacatggaagggcacccactacgagagcgggctgcgttacggagcgaaactttacgagcggcacatcaacctgatggaacatctggccgtggaccaggcgcgcctggactacgcccgggccgcgatccccgcgtaccggcggcattttccggagatactggacgagatccggggaattgccgagggacagaggacggagccggctcagatggaaggatttctgttgtccatgtacagctttgcggtggggaatcattgttcctgcgtcgcgtattcggatgaggacacggtactgttcgggcgcaacagcgattttctcaccgcggtggagccgttttgcgacagtccgatgtaccggctggagggagcttacggatttgtgggggctaccacggcctggtcggagatggaggacggggtcaatgagcacggcctggccgccggtctgacctttatgtatcccaccaaaattgcgcctgggtttaacgccgggatgctggtccggtatgtcctggagcggtgcaggaccgtggaggaggccattgaagcgatccggaaactgcccgtgggttcggctcaggccatcaccctggcggaccggagcggggcagccgcggtggtggagtgcaactgcgagtctctggaggtgatccggccgggagatgggggagcggtgttttcgaccaaccattttgtcagccgggccctgacgccttaccagacgcagatggaggacacggttcactcccatgagcggtacgagaccatggagagagcgtttgcacagcggaaaacgtggacggtcgggcagattcaaagcctgctttctggggaaatgggctttatgtgccaatatgaccgcagcctgggcatggacacggtgtggtcctccgtttacgacctgaaaaacggtttgattctgagagcggagggaaatcccgcgcgctgtccatttgacccggacgggcggctttggccggagttttaagcgctggcgcaagtctctgaataggcgttgccggaatgcaatatactaaaccgaggtgatgcgatatgcagaggcataagaagttatacgggctgtcggtactgctggcggtgggcgtcggcggactgtccgggtttttgagccggaacgggatgaaggagtacgcgtccttaaagcgtcctcccctgtccccgcccggcgcggtatttcccgtggtgtggacgatactctttatcctgatgggaattggggcggccatggtctggctgacgcgcaggaccgagcgggtgcgcgcgctggcggtctacgggattcagctggccgtgaattttttctggagcatcctgtttttccgggagggtatgcggctcctggcgtttttctggctgctgcttttgctggggctggtggcgcttatgatccggctgtttggccgggtgagccggaccgcggcctggctgcagcttccctactttttctggctgtgctttgcggcatacctgaatctgggggtgtggtggctgaaccggtagacgggaacattttagggaaatgcgcgggagtgggacggcggttgaacggaagaaacagatagacgaggagaacaaatgatactgagcgcaagccgcagaacggatctgccaaactattacagcgactggtttttgaaccgggtgcgggaggggttcctggatgtgaggaatcctttcaacgcccggcagatcagccgtatttcgctgtccccggaagcggtggactgcatcgtgttctggaccaagaacccgggccctatgttggagcggttgggagagctgaagagctatgacttttatttccagttcaccctcacgggatatggcgcggaggtggaggccggtttgccggacaagcggcaggtgctgatcccaacgttcaaacgcctggcccaggagctgggcagggagcgggtggtctggcggtacgatcccattttcatcagcgggcgttatacgccggaatatcatctgaaagcgttcggggagatcgcacggtcactttgcggttctgcggacctggtggtgatcagtttcctggacctgtaccaaaaaatccggaggaatatggaacgtttgcagatggaaccgatggggacggaagcgatgctggaactggccggagccatggcgaagatcgcctccagctgcgacatggccatcgagtcctgcgccgaggccgtggacttatccgccgccggggtggcccacggcagctgtatcgaccggaagcgcatcgagcggatcaccggcagccggatccgttgccgtaaggacgcaaaccagcggccggaatgcggctgtgtggagagcgtggacgcgggttcttacaacacctgctttaacggctgcgcgtactgctacgccacctttgaccgggcgcggattctggaacaccgggccgtttttgacccgaattccaccatactgggagcgccgcccgggccggaggacatcgtgcgccccagggccctgcagtcgtttaaggtcccgcagatgagcctgttcgacgaaaacggcccggaccaatagacaggaaggagcagttttgccatgcagcttggaatcacaatcccgctacagaaatttttaaaatggaagcccccggtttacggggagccggaaaatctgtttttctgctgggatctccatgtgatccggtttcacggggagaacacgctgatggcggtcaacgcctccaacgcatttaccgtgattctctggaaaatggaatgggcggactgggagaatctggggcagcggacccttgaggccatccgcaaggggcttttggacgcggggtacggcgaggagacggcggaggcgtatttctgggcagccgggagcgcctcgtttaccaagacccacggccggcggccggtggcggccctgaaccgcatgacggatttcctgcgccaagcgcccatgaagctggaggtggaccggcagttccagtccgcccactgccgttttgtgaatggaaatcttctgaaaacagccgggttcgatttgccgggcaggccggaagggtttttaaacgaagatatggaaaaaaatggggttaagccggatcgttgcgcccatgagccgtcgcccggcgcagaaaaatgcccctgccgcaggaaatgtccgcggcgggggaactgtgaggagtgcctggcttttcaccgggatcagaagcccggaataccggcggcctgccggaagaaaaagcggtagcgcaggttttgagcacatttccgggaacgtctgaaataggccagggagcgcgttcattggcagtattcacgggccattttttcaaagatctgcacgtggagttgttcgtccagaatgatccgctccagcagcgccgtgatgttgggatcttttatgtaggaggcctgatactggtattttttgatcgcagcgttttctccggcgatcacgccgcgcatcatttccgggaaatggacggggtactggttgtaacccggagtccagtaggctttcttgcagccgtgctgggtccacattctggggtcctcccccagcatacaggccagcttcccaaagatttccagatgatgcatctccacgatgctgactttgtggaaggtttgggcgatatccggggtgtgaccggagcgcaggttgttgtatacatagagggaaattgcggacatttccgagttggctccgcccacattgtccagcatggccttggcgtaggccgggttcttgccgtccacagcaaccggcggataggggagatccgaggcggcggcaatgagttttggttcgtccatggaacactccttgtattgagattatacctacagcatatgtgggcggaaacgggaatatgtgagggacgggcgaaggagaggtttactttatgaaggaattatttaccatcggtgagatggcggagctgtttcagatcaatatccggacgctgcgctattacgacgacatcggactgctgcgcccggagaccgtgaacccggaaaccggataccgctattattccaccaaacagttcgagcggctgaacacgatcaaatacctgcgcaccctgaatatgcccctggaaaagatgaagcagttcttccagaaccgggatgccagggtgatggagcagattttggaggaccagctgtttaccaccagggaacagcttgcacagctgcaaaatatggagcggaagctgacccgcaggctggagcagctgcgctacgccctgaacgcgccgatggaggaggtccggctggtcaccctgccccaacggccggtggcatttttgcgccgtcagattgcccagggcgagaatctggaatatccaatccgggagctggagcggatgaatgatttgaaaccggtgatgtttttgggaaaagtgggcgtcacggtggatctaaaggagctgaggcaggaacgccccacacggttctccggtattttcgtctttttggaggaggaggacaattatcagggcggcgcgcagacgctatcggagggggattacctgaccatcctgtattccggcacccaccaggggtccgcgccgtattacagacggctgttcgcggccatggaggagcgggggctggttccggcgggcgatgcggtggaaatcacctggatcgactccggcttcacccaggacgtaagccagtatgtgacggagctgcagcttccggtgcgggaaggatgagatggggaggaaacggcaaggggaaagacgaaaaagttccccttgactttttttgcaggttatgcaacaatagttgcataacatatgttaccaaatgctgctttactgtaagagaggtctaagctatgccgcccaaagccagaataacgaaagaaatgattctaaacaccgccctggatctcaccaggcaatccgggtttgagactgtgaacgccaggagcgtggccggacggctgcagtgttccacccggccgattttcacctgctatgaaaacatggaggagctgaagcgcgaatttctggccttcgcatatgagttttaccaacagtacgttgcagatttccgtaaatccgttaaagtcagcccctgtttagtcctccccctctcatacatcgggtttgcccgggaggagacgcagctgtttaagctgctgtttatcagcgatatggatctgaaaatggcgaatgccagggatttctacgaggaaatcgacaatgaaaagagggcggaggagttcgccggactcattggggtggagacggagcgggccaaggttgtatttttggacctgtttctctacgcccacgggatggcggtcttaactgcgaccaacaagatggcgctggaacaaagcgatgcaaaaaagctgttggctaatgttgtgacagcgcttatcagacaggaaaagccggactgggacgcagaaatgctgcgtgtccattgaccggtgtggagggccgcgatatgaaaacagaccagtatttaattgatttttacaaccagtacgacgaggacagccgcctggcgcccaggcacggttcggttgagtttctcaccaccatgcgctacattgagaagtatataaggcccggacaccgcgtgctggaggtgggggccggaaccggccggtattcccacgccctggcgggccgggggtatgccgtggacgccgtggagctggtggagcacaatatagagattttccggcagaatacgcggcccggcgagccggtcacaattacccagggaaatgccatggatctgtccacgttcccggacgatgcgtacgacatcgtgctgctgttggggccgctgtaccacctctataacgcggaggataagcggcgggccctgggcgaggccatccgtgtgacgaagccggggggactggtgtttgcggcctatgtcatttccgacggctgccttctcgacgagggattcgggcgcgggaatatcagcgtggccgaatatattgagacggggctgatcgatcccgtgacatttgccgccaggtcccagccaaaggatttgtttgaattggtccgcaaggaggatgtggatgagctgatgtccgtatttcccgtgacccggctgcattacgtggcttcggacggctgcgccctgctcctgcgggaagcggtggacggtatggacggcgggacgtttgagctgtttatgaactaccattttgccacctgtgagcgggcggacttgcttgggatcaccagccacgcggtggacatatttcgaaaatagacaaaaagtggtaacagttcaaacgactcatcttctaagcttgacgcggcctttcgcgccaattttcccgccgtctgaactgttacaaaaaatgcttgaccctccagttgctggagggtttatttttttaatagtgggaaatgcgccggacgggggatcacggaagtggccctccacgcgatgtttccttaaaaataccggtaaaaataaaggctgcgcccagtttcaggcgcgctgtgggaggaattgagatgaagcaggaacagaatctgacggaaggccctgtgctgaaaacgttgctggcgtttaccgtcccctttattatcgccaatgtgatccaggccctttacggggcggtggatctgtttgtgatcggccgctactgcccgccggagagcgtggccgccgtgtccaccggcacccaggtgacgcagatcatcaccagcatgattaccgggctgaccctgggcagcaccattctggtgggaaaatacactggaatgaacgcgaaggaggaggtgaaaaagactatcggcaccaccctcagcgtgttcgctttggcggcgctggcgctcaccgctgccatgctgctgcttgtgacgccgattctggagcttttaaagacgccggagcagtccttcgccctggccaggcagtatgtggtgatctgcagctgcggcattttctttatctgcgggtacaatgccatcagcgccatcctgcgggggtacggcgattccaggcgtccgatgatgtttatcgccctctcctgcgccctcaatgtggccggggacgtgattctggtgaaatacgccgggctgggggtggccggggttgccttagccaccatcggctcccaggccatcagcatgatctgcgccattgtatacttaaaccgcagcaggttcattttcaccttcaccctgtccaacctgcgcatcgattcccggaaggtgcgggagctggccgcggtgggcatccccatctccctccaggagtgcatggtgcggctgtcctttttgtatctgaccagcgtcaccaaccgtctgggcgtgtacgcggcggccgcggtgggcatcgccagcaaatacgacgtgtttgccatgctgcccgccacctccacggccaacgcgctggccgcggtgacggcccagaattacggcgccggaaagccggagcgggccagggcctcgttgtttgccgggctgggcttcgcggtggcggcttcttccttattctggctgtgggcccagttttcacctgagacgatgatcggcatgttcacaagggatggggcgatcataaacgagggaatcccgtttttcaggtcttgcagctacgattatctggcggtcagctttgtgttctgcttaaacggatatctgaacggacgctccaaggccattttcaccatgatcagctgctgcttcggcgctctggccctgcgcatgcccctcatctggctggtgtacacctattggccggacaatctgctgcggatcggctccatcgccccggcggtctccgggtttatggcggtttacacgctgatttatgtggtggtttcgattcgcagggagcgggtggagcggacggaagacgcggcgttggcggagtgagggagaaaattgtttgggccggtatgtcagattgagggtttcacggctgtaccggaagaattaccttgaaattggtcccaatccccggctcgctgtagacggaaacagagccgccgtggagttcggcgatgcgcttaaccactgtgagtccgatgccgttgccctccgcggtgtgggacaggtcgccctggtagaaacggtcgaaaatgtggccgattatctcctggtccatgccgcagccgttgtcccagatctgaaatcgcacctgggggccgtcggcgtggagcttgatcttgaccttaccgccctgaggcgagaacttgacagcgttgtcgatcaggttgatccacatctgattcaacaggtctttattcccggagtagacgatttcgtccagctccagaatccattccagttcctttttctgccacttagtctccagcagcaggatggcctggcggatctcctcgctcagttcaaaggcgctgacattcgtgagaatgctggtattctccaccttggacagattcagcacgttggtggccagttgggccaggcggttggactcgctgataatgatatccagatattcgtcccgctcctcccgggtcagggtatcgctttttaagattttggcgaagccgcgcagggatacgatgggcgtcttgaactcgtgggaaaaattgttaataaaatccgagcgcaaaagctcggtattttccagttcctgggccatacggttgaagctctcggacagcttgacgaactcctgggtcagatccaggtggatgcgcacgtggaaattgccgtcggccagctcgttgatggccgcgatcagctggcgcacgggttttaagggaacgcggctggcgatcacggtgagtgccacgcccgccagcaggctggtgagcaacagcagggggatggggcgccagaactggggaatgggcacgtcggcccggtacagaatcctcagatacagatacatcagcaggccctggagggtcatcacggtcagcaggatcaggaaaatgaacagggtgatccctaaggtaatgttgtggagcggttttaagccgcgacgctttttcataggtttttcaccgccttgtagcccaggccgcggatggtctcgatggagaactcggggtaaccttcgaaacgcctgcgcagccggttgacgtgcacgttgatggtgttgtcgtccgactcggactccatgccccagatctcgtccatcagctggacccgggtaaagatcttgcccggataggagagaagcttgtacagcaggtaaaattctttccggggaagggtctgcacctcaccgccccgggagacggtcagggcgtcgtagtccagcaccaccggccctaaggtgatccggtgctcgtttacgatctgcgcccggcgcagcagcgctttgatgcgcagaatcatttcttcctcgtccaccggcttgatcatgtagtcgtcggttccaacgatgaagccctttttcttgtcctcgggcagctgcttggcggtgaccatgagaatgggcaggctgaaatgcgtctcccgcagctgtctggtcagctcgtagccgtccaggccgggcagcatgatatccatgatcaccaggtctatgtggcaggtgtccaaaagtctcagcgcttccatgccatccttagccggaatcggataatatccgttttctttcaacaccgcttccatcaattttcttgtattcttatcgtcttccacaatcaatatctgaaacatttgcaagcctcctgtcctaaactgcaatagtaatataacaccaaaatattaaatgaaggtgaataaaacacagaatcttcacaattaattttccaaacttaacggtttgtttatgttcaattcatgttgcagtcttaaaattcatgggagagtaaaatgaagccggtgcgcggttctggcgggccggggtaaggagatcagaagtatgagaaggaaaaaggcgatgataatcggcggcgcggcggtagtggctgtagctgccgccgttctgttgctggggggaggaaagaacaaggcgtcaggaggtcccgcaggggggccgcggggaggagctgtgtcggccaacgtgccggtggtaaaagcggtgaatcccacccagggagatatccggctgacctcgggcctcaccggcacggtggagcctgcggatgtggtttacgtgtacgccaaggcgtcaggggatgtgaccggggtgatggtgaaggccggggatacggtgacggccggtcaggtgttatgcgagatcgataccaaacaggtggagactgccagaaattccctggattcggcggaggtgtccctgtccgaggccaggagcaatttaagccgaatgcagattctctacgccagcggcgatctgtcggcccaggactacgaacagtacagcaacaaggccaagtccgcccagctgcagtacgagtccgccaagctggcctacgaccggcaggtggagtacagcaccgtgaccgcgcccattggcggccgggtggagagctgcgacatcgaggtgcacgacagcgtgggccagtccacccagctttgcgtgatcgcaggcgagggcgacaagcgggtgtccttctatgtgacggagcggatgatggccaatatcaccgtgggggaccagctggacattacgaaaaacggcgtgacctacaaggcgtacgtcagcgagatcagcgccatggtggacgcggataccggcctgttcaaagtgaaggcccagctggagggcgcggacgccattcccacgggaagcacggtcaagttgagtctggtgacggaccgcacggaaaatgccatgctggtgcccgtggacgccatctactacagcaacggcgacggatatgtgtacctttaccgggatggagtggtggagcggaccgccgtggaggtgggaatttacgactcccggaacgctgagattttgggcggtttgaatagggacgatctggtgatcagcacctggagttccgatttgtacgagggggcgaaggtggagttaaagggggcggacggcgcaggcgatgcggccggtcagccctcaggcgaggcagccggccaggaaacgggcccggcaggaggcgcaggcggccaaggcgcccgggcgcggtaggggggactgacatatgggaatcacaaaatttgtgctgaagcggcccgtggccacggtcatggcgctgctgtgcctgctggtgttcggtatttcctcagtcttttccgccactctggagcggatgccggagacggaccagcccatgctgatcatcatggccccctactccggggcgggtccggaggacgtgtgcgagctggtgacggagcccattgaggacgaggtcagcaccctggagggcgtgaagagcatgagttcttcctcctcggagggcagggccatggtgatgctggaatacgattacggcacggacatggacgaagcatatgaaaatctgaaaaagaagatggacagtctggagcgcaagctgccggacgacgtggagacctcggtgatggagatgaacaacaattcctccgccaccatgtccctcaccgtggctcacgacagcgagccgaacctctacgactacgtggaccagaaggtggtgcccgagcttaagaaaatctcctccgtggcggatgtggaggccatgggaggctcctcggagtacatacggatcgagctgcaatcggaaaagatggcccagtacaaggtgacggtggaccagattacctcggcactgtccacggccagcctggcctacccttcaggcgacacggtggccggaaatctggaactgtccgtgtccacctccatggaaaacgacactctggacgatctgaaacgggttcccatcaccacgggatcgggcaaaatcgtgtacctggaggacatcgccagcatctacgaggccgaaaagacccgcggcagcatttcccgctacaacggccaggaaactatttccatttccattaaaaaacagcagagcagcacggccatggaggtgtccaaggcggttcagaaggcggtggcctccctggaagcggcggacgatgggctgaccatcaccgtggcccgggatacggcggacacgattttaagctccctccaggacgtggcggtcaccatggtgctggctgtgttgatctccatggcgatcattttcattttcttcggagattataaggcgtccctgatcgtgggcagctccattcctacctccattctgctgtccatgatcctgatgacgtcggcgggcttttccctgaacgttatcaccatgagcgctctggtgctgggcgtgggtatgatggtggataactccatcgtggtgctggagagctgctttcgggctacggcggaatccgaggaccgggggcttttgggctacgccaaggcggccctcggcggaaccggcatcgtggtgcagtccatcctgggctccacggtgaccacctgcgtggtgtttattccactggcatttttgcagggtatgaccgggcagatgtttaagccaatgggatacaccatcgtgttctgtatgatgtcgtccctgctctcggccatgacggtggtgcccctttgttacctgatgtataagccgaaggagacggagcgggcgcccatgaaccggccggtggtgcatatgcagaacctgtaccggaagattatgggaaaactgctggggcaccggtggatcgtcatgggggtatcggtggtgatcgtggtggttacggtgattctggcaagcggtatggaatccgagctgatgactgcggacgacacaggcacggtcagcgtcaccatcgagaccaggccgggcatcctctccgagcaggccgaggatatgttgaaccgggccgaggccgtggtcaaggcggaccacaacgtggagtcttacatgctgcgctacagcaacaacagcggcaccatcaccggctaccttcgggatgaccgggatatgtccacggacgatgtggcggataaatggaaaaaggagatggcggatatcgacaactgcaccatcacggtggaggcgtccagctccatgagctttatgaggcggagaaccgattatgaggtgattcttcacggcacccagtacgatgagctgaaagaggtcagtgacaagattgtgaaggagatgacggaccgggacgatgtgatcaacgtgcactccagcatcgagaacaccgcgcccatcgtcacggtgaaggtggacccggtgatggcggcggccgaaggcctgagcgcgtcccgcatcggctccatggtaaagcagatgctaagcggcgtggaggccaccaccctgaaggtggacggccaggagatcagcgtgatggtggagtatcccgaggacgagtaccggaccatcgatcagctaaagggaattattctcagcaagccctccggcggttatgtggcgctggaggacgtggcggagatctactttaaggacagtccgtcctccatttccaagacggataagtcctacgagatcaccatcaccgccgattatacccaggggaacgtcaaggcggccatcgacagcgaagtgatcagccccaacctgacgggcaccatcaccacgggagtgaactccatggaccggatgatgcaggaagaattttccgccctgtaccgggccatcgccattgcagtattcatggtatttgtggtgatgtcggcgcagtttgagtcgccgaaattctccttcatggtcatgaccaccattcccttcagcctggtgggctccttcggactgctgaagctgaccggcgtcaccatcagcatgacgtccctgctgggattcctgattctgatcggaacggtggtgaacaacggtatcctttacgtggacacggtgaaccagtaccgcatgaccatggacctaaaaacatccctgatcgaggcgggggccaccaggctgcggcccatccttatgaccagcctgaccaccattctgtccatgatccccatggctctggctatgggaagcagcggctccaccacccagggactggcggtggtaaatatcgggggcctcagcgccggcatattagtcgcgctgttcctgctgccggtctactacgcgctgatgaacggtgaccggaaacgcatcgtgctggatctgtaaggaggtacctatctatgaagcgaaacagaatgattgcggcctcactggcatttgcaatcggggcgggaattggagcgggaaccggaacggccctgcccttaaccgtcctggcgggcagcccggagtttgcctacacggcggaaaaatgggcttctctgcgggacgataagctggagtttgaggagatcgccgacctggttcacgagtacaacaacacggtgattcagaatcagattgagtatcaggattaccgggatcaggataaggacgatatctccgacgactattacgaggcggcccaggacattttaaataatctggattacccggacccggacgaggccggttttgccagccgtttgagctcctatttgagcaacaaggtccaggccgacagcctgatggagaagggcgacgacaatgtggacgacggggagatcaagaagctgggctacgaccagaccgaggccggactggtgaagagcgcccaggagcagatgatcagctactggaagcaggtttacagcctggacagcttaaaggagtcgaagcagcaggcggagctgtccctgcaatccgtgaacaccaagctgagcgcgggtatgtccgtccaggcggagctcttgagcgcccaggacgcggtggattcggcccaggcttccatcatctcaggccagagcggagtcgacaagacaaaggagagcctgtgcctgatgctgggctggacctacggggcggcggtggagatcgggccgccaccggaaccggagctggagcgcatcgcggccatcgacccggaggcggatgtggagagaggtcttgcaaacagcttcagtttgaaaattctgcaaaaacagctggccaacgcggcctacggctccaccagagacaaactggaacagtctttaaagagccagagggtgtctgcggccaatagcatcaagaattcctaccggaatctgctgctggcaaaggacaattacgaccaggccctgcaggcatttgccctggagcaggacaatatgcggactgcggagacgaaaatggcggccggaaccatcacacccaacgattaccggaagcagcaggcggcctgcgcctcggcggagacatcagttaagaccaaacagctggacctgctgagcgcccaggtggattacgactgggccgtgaacggcctggccgggtcatgatggggaggtggacggatgaaatggaatgtgagcaggcgaaaatacctgcggtacaggagcgccaaaggcccggcccgcagcggggcagcggcagtgaccgtgaccgcggccctgatggttcttctctgctttgcgctgtctatcggcggggtgaataccgccttgggggcggagacaggggcgggaacagaggtggaaacaggggcgcaggtgattcaataccaggacctgcgggaactgctgaaggccggaaatccggggttgaaggaaaaaattgacgactacaacaacaacgtgcagacctaccaggacatgtgggatgccgttaaatgggagcagtgggacatggagagtaaggcggaggatatgaaggattcggacgccgccgcctcgtccctttatgcctccaacgcggctatgctgaagagctccgcccgaaacatgtataaacagattgataagatgaccggggagaaaagcacccgctccctggagaaggaggccgactccctgaccatggccgcccaggcgctgatgaactcctacaaccagatggcggtaaacgcccgggcaaaggccaaaaccgcggaggcggctctggccgcctgcgaggcggtcaaagcccggtattccatagggtccgcaacactggcggacgtgcaggcggccgagcagcgtttgacaaatgcgcgcaatgcggcggcttctatggaggaacaggccgcccagttgaaggccgacctcctgcttctgctgggcatggagccgggggcccgggtggagatcggggccgttcccgcgccggatttggaagcaatcgccgccatcgatgtggaggcggaccggaacaaggccctgggcaacaacagttccgtgctcagcgcccgccacgcaaaggcggtgggaaccgcggcccagaaccgccgggaaaagcaggtgaaccaggcagagggcgaggcggaagcggacttaaattccctgtaccagacggtggtggagaagcgcacggcctacgagggggctgcggcctcctgggagagcgcgcagattatctacaactccctgcaaaacaagcagagcgccggaatgctgacaaacaccgaatacctggagggggaggcttcctacctggaaaaacaggcggcctgggagagcgcgtccatggcgctgcggcaggcttacgagaattaccggtgggaggtgttgggggtgtcggaggcgaggcagtaaatgacacaaatgaattaaaaatcccctggggattaccgccagatgaaacggcagtacgaagcctttgagaaggcatgtaccaaggatttggaaggatttcctagctctgtattggagacattttgccagaaatgcagcaggagggcgggaaaaaaccaataaagccggatattctttgccgtgtttattacaatggatagaaatatgctgtataataatattctaggcttcacaaaagataggagggatctggtttcattgggtagggcggaaaatgaaactgggaatatatggaagaatatttatcaccaggcgtatatgtggaagaatttgaatccggggcaaaaccgatggagggcgttgggaccagcacggccggatttgtagggctggcggagcggggaccggttgtggggcatccgcagctggtgaccaatttttccgattttaagagaatctatgggggatatttatccgatcatgagttcggcgggtaccggttcctcgcctatgcggtggaggcgttttttgtgaacggcgggccgcgttgttttgtgatgcgggtggcgccgggggatgccaaaaatgcgcagggcgcggccgggggcgtttcctttaccgcccggaaccccgggctctggggaaatgacatcaccgtctctatccgtccctccagcaaggccaagacccaggtgctgaaggtggagaacggaacctacagagtgaaaagcagcgtgggcttttatccgggcgacgtggtggcctatcccgatggggagggaacggcttacaccagagttgtaaagagccgggacaacgtgctttcttttgagcacgagatccccgcctccgttgtggacacgaatctggtgccgctgcaggtcatcaccacctgcgaggctttgattgaggtgaaatacaaggatatcacggaaacatacgagaacgtgtccctcaacatcaacggggggaactatattggcaagaagatggccaaatccgaactggtggcggtctcctgggacggcgggcaggcagcggttcccatcgccgagattatgggacgttttgtgacctttgagggagggagcaacggttcggtttcctccgtctcagcggccgatttcatcggggtggacaacggcgcgggcgcccgaaccggcatccagtcctttatcgacaacgacgtggtgtccatcatggcggttccgggagtgacggaccccaatgtgcagctggccctggtggcgcactgcgaaaatctggccagccggtttgcggtgctggatatgccgagggaggccaaaacggtaagcgatatcatcgctcacagggatatattcgattcaacctacgcggctctgtaccatccctggctgatggtattcgacccgctggacaggaaaaatatcatgattcctccttctggagcaataatgggaatatatggaagaactgatgacacaagaggggttcacagggccccggccaatgaggtggtgagagcctgtgtgggtctggactgtcagttcaacaagggcgaacaggatatcttaaaccccaagggcgtaaacctgatccgggcgtttccgggacagggaatccgggtttggggggcgaggactgcaagcagcaatcccctgtggaaatatatcaatgtccgccgcctgttcattttcattgaagagtccatcaaggccaacacgagttgggccgtattcgagccaaacgacgagatgctgtggaggcgcgtgcagatgacgatcagcgtgtttctgaccggcctgtggcggggcggttcgctggcgggggtcactcctgaggaagccttctatgtgagtgtgggcagggagaccatgagtcaggacgacattgacaacggccgcctgatctgtgtgatcggcgttgcccccgtgaagcctgcagaatttgtgatcttccgaatcacccagaagaccaacgaagcggtagagtagaaggaaggagtgaacgataaatggcgtatccacatggacgttttagatataaggttgagatagacggcctgggagggggaggtttttccgaggtgaccgggtttaacgcctcggtcgatgtgatggagtatcgggcgggcgatatggttcagacgccgatgaagattccgggtctgaaaaaatacggcaatattatcttgaaacagggcctggcggattctatggtgttttacgagtggattgcggagggcgttaacggggcgattcagagaaagaccattaccattacgctgctggatgaggaggaaaccccggaggcatcctggcaggtgatcaatgcgtggcctgccaaatacacggcgcctgatttaaatgcgacctcctcggaggtggcgatcgagacactggagattgcccacgaggggatgacaagagtattataatgggcccatcttgggatgagcggatgagctggaaacgatctcctcgggtcaaaggatttgcagcttcggagagcccgaacaggcgctggagtatggggcgtgatcgccatgacccacatcaagaattatgccaagctgggctacagttcgtcccgtatcctggcggagaccaacaaccgcctgtccggacagaaccgcggggcgctgaccgtatccgtgttcttaggcatcctcaacctgcgcacgggtctgatggagtatgtggacggcctgcaaaatgacctggagcggttctctgaggggcgcgggcaggagttggaccgtacgatggtgttgttgcggtattttgggtgaggataagtgagtgattcagattccgaatgtgcgatagattttagatttgctgtccacatgcatatgtaagacccgaaggataatgacgctgtctaaaggcggagatacgatataatagattttataattcttatgatgacattttctgacgcccggcgtggccagaatactgtcctcatccagtgcatgtttttgcggcatttgcctgagtgaattcatcttattttttagatcatggattaaacaaattgcagaagcaggattttttagagtgaaggcaacatagttaccaatatcttccaaatcttgctctgcgtattctgtgatttttatatgatacttatgcattactatattttttctccaatcgttcacatacttcgtttaaatcttttgttcttccttcatttgcctggctgattgcctgtaagagcattcttctgaccttgatactttcaaaatctttttctgcttcatattcctgctttgctgttaatgccatatcattacctcatttttaataagcggcttctgctggatattgtctcatattttattataccggtctgcggtctattctacaagcatagtttcaagattcttaacacaataattttcagcagttcattctatccggcgatgacctgcgcgttcccaacttcgttaaaaaattagtaaaattcatgtaaaatccaaccaaacccaatgtaaaattagcgattatatgcaaaaaatgtgctaaattccacacaaaagtgccggattaccgcatggtcaaggccgcggccgtgttgtatgataggtttatgacgcaaacagaaccaacaaaatcaaaggaggatgtttatgagaaagatatggaaaaagctggcggccgcgggactggcggcggcgatgacggccacggctctgaccggctgcggcggcaaggagagcgctcccgcgggcagcgaggcccagaccgaggcggcaagcgagccggtggagatcaccttctggcatgtgtactctgagaacttcggagctccggtgatcaaggagatggtggaggagttcaacaagacccatccggatatcgtggtgaaagaggtctacaatcccgacatgtacccgggcctgatgcagaacttacaggctgaggtggcggccggaaatcccccgtccctgtgtatgatcggctacaactacatcaaatatttcgcggcaaacttcaactacgtcagtccccaggacgtgctggaccagtatctgcccgaggacaaggactacttgaagaacaccttcctggacaacgtgatgagcctggcccaggtggacggaaagcagatcggaatgcccttctgcatcagcgctcccatcatctgctacaacccggagctgtttgagaaggcgggcctggacccggccaagggaccggagacctgggacgacatccgcgagtacgccaagcagatcacggacaagaccggcgagtacggcttctacatgcaggagtacgccgacaactgggcggttcagggacttttagagagcaacggcgccaacatgctccaggacggcaaggcggcattcgctacccccgagggcatcgaggcataccagattctggccgacatggtgctgacggacaagagcggattacatatcaccgccgacgagggcatccaggctttctgtaacggcaaggtgggcatcgcctgcgtttccagcgccaagatcggcaccatcacccaggccgcccagttcgacgtcaagggcgctgagttcccgggttttgagggcaaggagaaacgcctgcccaccggcggaaactttattccgattaccgcccagacgcccgaggagcagaaagcggcaatggagttcttaatgttcatcatgcagccggagtggctttccaagtggactttaaacaccggctatctgccgcccagacaggacgtggcggaggatcccaacggcctgcaggcccacatcaaggacgacgtgcttctgggcgtggcctttgaggaaatgcagtatttacagccctgggccgcttatcccggcgacatgggaacccaggcggagcagatgttcgccgacaccagagacaagattctggacggcaccgagaccccggagacggcgctcaaatccgctcaggacgctctgaacaaaatgctggaagagcagtaagacataccataaaacgggaggagggaagacagcgggtcttccctcttccggcaaagagaggagaaagaccctatggagggaaaacggttgaaccgcaggaagcgggaccacatcatcgcatggctgttcctgtttccggcgacctttgcgttcgtggtgttcatgttctggcccctggcctacaccgtgtatttgagctttttaaagtggaacatggtggctcccaccaagaagttcgtgggctttaaaaactacgtcagcatcgtccaggacgaggtgaccatccagatcgtggcaaacaccctgttttacatcgccattctggtgattctgattttcgcaatcccctatatcctgtcctatgtgaacacctttgtgatgaaaaagggcaagagcatctacaagaccctgctgtttatccccagcctgatctccctggtggtgggcgcaatcgtgctccagtggattttcaatcccatctccgggccggtcagcgggattttggggaaatttggaattacaatgccaacctggtccaagaccaagggcctggtgatcttcgtcatcgccctggtggccgtgctcaaaagcttcggctacaattttctggtgctgctctcgggcatgagcagcgtctccgacgagctgattgaggcggcaaagctggaaaagaccggtcacaccaaaatcttcaccggaatcgtgatgcccctgacctcgtccacggccatctacgtgctgatcatcagcattgtccagggcatgcagtacgtgttcacgcccatcaaggtgctgacccagggcggacccaacaacgccagctccaacatcatttatggggtgtatcaggaggcgttcaccttctacaatacgggaaaggcttcggccctctccattctgaccatggtgattttcctgatcctgctgtacctggaatttaaatatgtggagaagggggtctactatgaaaactgagcggagaacggaaatgatctggcacgcggtgctgatcctcatcgtgtttttgtccctttaccccatatttttcgccctgtccacgtcctttaagacgttgaacgaggcatttaacagttcgtccctgatcccgaaggagttcaccaccgcggcctacgccaacgtgcttcagaagattccctttgtgaagatcacggctaacaccttcatcatcgcctccatcgtgacggccttcaagctgattaccggagtattggcggcctacagctttgtattttttgaatacaaggggaagaattttatgtattttatcctggtgagcaccattttcatccccttcaccgtgaccatgatccccaactttatcacgatctccaaaatcggcctcagggacaacatcctgggcgtggccctgccccagctggcggacgccaccggcattttcctgctgcgccaacacatgaggggaatccctaagtccctggtggaggtggcaaagctggagaaggccagccacacaaatatcctgcggaccatcgtggtgccgatggtgaaaccggccattctttccatcggaatcattttcttcatcaattcctggaacgagtacgtgtggccgtccctgatcttaaagtccacggagaactacaccctgtccctggcgctgcagatgttcgtcagcgcggagggcggcacggatatcccggtggcaatggctatttccgttctgaccatgctgctgccccttggcatctattccgtatgccagaaatacatcatcaacacattcgcacagtcgggaatcaaaggatagaaggagtgaagcgctatggacagcattcgttttgaaaatgtgagcaaatcgttcggtaagacgaaaatcatcaacaatctgaacttgagcatcgagaagggggagcgcctgatccttttagggccgtccggctgcggaaaatccaccattctgaggatgatcagcggcctggagaccatcaccaccggcaacctgtacctgaatgggaaactggccaacgacgtggacagcggggaccgggacatcgccatggtgttccagaactacgccctgtacccccacatgaccatcgaggaaaatgtgggctacggcctgcgcatccacaaggagaaaaaggacgtgatccggcagcgggtgaaggaggccatcgacatcttaaacctgaccggcctggagggacgctaccccaaggagctttccggcggccagcgccagcgggtggccctggccagagccattgtgaagcgctcggactttttcctgttggacgagccgctctccaacctggacgcacagctgcggggccaggccagaaaggagctggtgcgcatccatgagatgtacggccagaccttcatctacgtgacccacgaccagatcgaggccatgaccgttggccagcgcatcgccctgttaaacggcggcgacctgcagatgctggacaccccccacaacgtataccaccgcccggccaacattttcgtggcaaaattcatcggctccccgtccatgaacattctgaccgtgaaaatggacggacgggacctggtgctgggcgatcagcgggtggagctgccggaaatgtggcagaaaaagatccacgagaaggagggccgcagcctgaaaatgggcatccggccggagaacgtggtgttcagccgggagaaaggcccctacagcgtcagggtgaatatccactatgtggaaaattatggaaaccgcgtgggcttttacacggaaatcgacggcgaggagctgatttccattatgccggaggacgagttcgccaagggcgaggacgtgtactggaacattctgccggagaagctgcatttcttcgacggcgagaccaccatgtccatcgggtatccggcggaattgtcctgagaggagaaataaaatggcaatatttgtaagttccctgatcaaagggttcggccagatggaggagatcgcccgctgggtggacggacagggacgggactggctgggggtggagctgatcgctttcacccacgatgaggattactgggaacggctgaaccggctgctgcccaccctgacctgccccctgaccttccacggtccctacatcggtgtggaggcggcaagcccaaggggcacggcggactacgaccacatggtggacagttaccggcgggtctgcggcctggccgcaaaatatggggtgcggcacatcgtatttcactacacccaaaagggcgtgactgaggaggagcgtttccgggcccagaccgtaagccgggaaaatatacggaccgtgcttgacatcggacgggagtttggcgtggagatcgtggtggagaacctgccgtttccggcttcggaccagccgctgtttgacaacgaggagtacgccggactgtaccggaagttccccgatctggcgggaatcatcgacgtgggccacgcccgcctcaccggcctggacatggaggccatgctggcggactggggatcccggatccacgcttaccacttccacaacaacgacggggtccgggactgccacaaccgtctggacgacggcgtgatcgattacagggcgttggcggcgctgtaccggaaatatacgccggacgcccgaatcgtgctggagtacgagccccacgcctgggtatccgaggagcggctggcgcaggatatccgtctggtgcgggaattatacattgtcgcagccgcaggctgtcgataagcgatacgtttccttgatggatcaggagtagtttgagggccggaaggccggaaacagcgtcacagcggcgggcaggtcatctgccggccgctggctgcggttttgcggttgtggtggaaattaagaggcggggccgctccactttccggttgagcgcaggttgacggcatggtacaataagaaaacgcgcggctgtttttccccgctgcagccattaccaatgatcttagattatttgcgcggcacgacgccgcgccgggagtgcgccaggtgaaacgaatctattttaaacggctatttttggcatttttatttgcgaccattctgcccatctgcctctgtgtggcggccatctcctacggcagcttccacatgtcccgggagcgctaccaggacaaggtgggcgccatggctgcggccagctcgggaaatgtgcgggagcttttggaggagtatgagaaaattttaaacagcctttctgcggagcccgcccttgcggcgtaccttgcggagaatgaccgggaggggctgggagagctggtgcgcccgctccagacgggccgcgacaaccgtctgcgtatccgggtgatcgacccggacgaccggtacatttacccggacggccgggacgcgaagctctacgatccggcggtgttcggcggctggggaattttatacgagatgaccgcgtatccggaccggatcgccgtcacccccagcgtcacccgggcggagaacggccggaagatctgcctgaacatgggccgggcggtacaggggcgggatggcgggatcgccgggtatgtggttctggacgtataccggaacacgcttctgaacgcggtcaagcagctggaggatgagaaatcctccgtcaccttggccgaccgcaacgactgcattatcctggacaccaccgggcggtttacggaaggggccaccggcgcgccgggcagggcggagaagaattccgttgcggctttccgggaaaatgcctacggcctgcgcatttacgcctactacaacatcgaggagttcaacgagaacagccgtctgatgatctttatcagcctgctggtgctgggctgcatggcgcccctggccttcctgctggccgccgtgttcgccaaccgcatgtaccgccccatcgacaccctggtcagctccatgaacctggtgacccggggaaacctggataccaaaattgagatccgggcccacgacagcgacgagatgcgcctggtcagctcggtgttcaactggatgattgcccgcatacagactctgatcgagaacgccagggaggagagcgagcgcaagaaaaatgcggagttaaaggctctccaggctcagatcagccctcattttctctacaacatgttaaacgagatcaacgccctggcccggatgggccgcacaggggaggtctcaggctttgtgatccatctgggcaagctgctgcgccggagcatcaccttcaaagacgatttcgtgaagctgagcgacgatctggtttttgttgaggactacatacggctccagcagatccgctacgaccagctcttcgacgtggacatccgggtggaggaggagatcaaggactgcctgatccccaacctgatcattcagcccctggtggaaaacgccattatccacggcttcacggcgggcaaggagggatacatgctgagtctgcggggataccgcagggaagaggacgtatgcattgagatttacgacaacggcatcggcgtggataaggaatatttgaaatacatcaacaatgtggaaaagggcgtgggcctctacggaggcttgggcgtggagaacgtgcagaagcgattgcttctgatttacgggatgcgctatggaattaagatggagagcgagaagggccgctacaccaaggtggtaattctcctgccgtaccggagagagcaggtggacaagacatgaaaatgggaatgagtcgtttgctgattgcactggcggcggttgcggccggaggggcaatctttgccgctgcaaggcggtatacgccggcccaggacaatgcggggcgggagacggtggagctgaacctgctcatgtccctgggcggggacggcatgcgggaggaatacatgcggcggcgcctggacgcttacggcgagctgaacccggatgtaaaggtttccgcaacctttgtggagtcggacaccctggtatttctgaagctgctctacgcgggaaaggggtaccactacgacgtggtctgcatgggggacgactccatgctctccgcggccgagcagaaactgatctatcccatggacgagttcgtgatgagggatttgggcctggcctggctggacgccgtgccgggggcctgtctggagaacacggtgagcgggggaaagatttatgggctgccgtttcttaagagccgtctgaaggtgtattaccgggatgaaggaggcggagccgggaagagcggcggagtcggggaaatccccgccccggtcagcctggaagcgctgcttcaaacgtccggcgggaaacgcctcggccttccggtcagcgtgctgcttcgggacctgctgctatccacggacagctccggttgggacgcgcttctgggggagaccgagcgctaccaggtggaccgcccggaacgggctgcgctgctgcgcgccatgaaaaccggattggagcggggaaccctggtggacggggacaaccagactctgatggaggagtttgccggtggccgtctggacgcggtggtgctggaagaaacttacggggaggagctggagcgccgcgcaggggaaacgctgtccgccgccgggctgtggcggaccgaacagacgccctggctcttacagggctgcaacctctatctggccaaccggggaattccccacgactacggaccggcctgggagctggtggaatatctggtgagggacggggaattcgacgtccggacaggggaggagcgcgacatggattacaagcgcaccctgtccagaaagaacaccaaggcatatctgatcgtggaccgcatgatcgcggattttctccacggggacgaggactgcggcgaactgctaagagggcttcagagccagctggacacagcccttggcgagtgaaaatggatccggaaagaggttgaggaatgtatcaggtttatatagtggacgacgcggtattaacccgcaaggcgctggtcatgaccatgccctgggaccagtggggctgcgtggtggtagggtccgcggacgacggggaaaaggcgtttgaggacatccgggagatggagccggacattgtgatcacggatatccgcatggtgcatgtgggcggcctggagctgatcgggcgctgccgggcccagggaatccgctcccagttcattatcatttccggctacaatgaatttgagtacgccaaggcggcgctgagaatggaggtgctggactatatcttaaagcccatcgacgacgaagaactgcacggtgcggtggaaaaggccgtgcagcgcatcggagagtcccgggccatgatggcggagcaccgggaacaggacggggagagcaggtccctgctgctggaatatgatgaaaaaaatataaacgcctacctgcgccgggccctggaatacgtgcaggcaaactacggcagggagctgtccatccgggacgtggcctcctatctgtccatcagcgagagttacctggcaaagctcttcaaggtagagcttaaaatcacctttctggaatacctgacccgggtgcgcatgcgccgggcaatggagcttatgcgggacaagaacatgcccatctacgaggtggccgagcgggtgggctaccgggactaccggcatttcagcgccaccttcaagaagctggcgggggtagggccaaaggaatttcagatgcggtcgtgaaatgccgccggagggggctgaaccgttcgcgcaaaatgcccgatcagtatccccgcttaaaacccgtgttccgccgcctcccggacgaactcccagaaacagtctgtggccgccggaagcacctggtggcagcggcgcaccatcagcaggttggacagatgctccgggttcacgatgcggcggcagcacagcttctgcggattcatggtgtagcgcacggattccgggcagatggccacgccgatgttgccctccaccagagggatgatacaggagaccgtgttgtacaggcagaaaatgttgcgttcctcggaaatgtgattgaaccagttgttgatctcatcctgcatctcgctgcgggccgggataatcagggattctccggagagctgtcctagctccaccgtgtcctccgtgctctgggacagggggtgattcacgctcatgagggcgatccaggactcctgtttaataaaaatgtgatcatatttttccgtattaaagggctcgcggacgatgccgatgtctgccaggcccttttccagtttttcacggatctcgtccccatttccgcaccacacgctgtagcggatgttgggatactggcggtggaaatcgccgatcaggccggagaggatgctggccccgcaggtctccgtcacgcccagggcgatcgtcccgtgggtggaattcttgatcttccccagctggttctgggttttctccaccagggtgatgatctcctcggcctgctgctttaagaacagaccctcctcagtcagccggatgcggcgtttgccccggataaagagggtgacgcccagttcttcctccaaaagctgcatgctgcggctgagcggaggctgggcgatgcagagcgtttccgccgcctttgtgatggtgccctcccgggctacggtgaggaaatatttgagtgttttcacgtccatagcggataccaacctttttgataggataagccggtggagccggcatgtaagggggcgttgaaaggtgagaggcggttgaaaggtgcggggcggttgaagggtgaggggccgttaaaaggtgcggggccaccgccgcgtgtaaccgctggtgagcgggggacagaaggccgcccggctaagggtacctccacaggcggcccgagctgtctctgtggacgatttccgtaaagctgctgttgaaaatataggtgtcaaaggccacggcaaacagatcatcccctctgtttggaagcggccctccgccccacgccacggcgggaagcgcagcgtcgtcccaaacaatgtaccaggtctgatccgtgccaaagtccagttcatccaccgccgccgggcgggccccttccatgtgccggtgctcatcgaagggaaaacgcccgcacatggaatggatcagcccacggatctcctcctcgccctcgatcagccggacctccccgagggagcggatacaatcctgaaacagttcgtgcccctcccatgttttccggcggacaaacgctctgtttttctccttcagctgttccagtctgactctgtccatagttgcccccgcatcgccaatagtttcttttattctaacggccgtgtggggaaatgtcaaatacggcggggggagggacggggtaaatcctgcttctccattgtggccgctgccccgccctctctgcccgccttcaggtgttctcatatcgattatatcatacttttaaggtattgtagtccatatactatatgtatttggaaataaaaaatttccatggtataatcagaaaagcaatgcgcccgccgcccgcgaaagggttgacggcggccgctcaaaagaatcggatgtataagaggttgatgggaggatcattgaggtgagagaggatcaggcagagcggtggctgcactatgtcatgtcgctgatcgggggatttctgggcggatacgcgatattaaaccgcagcggccttttaggggcggcccagacgtccaatatgatcaacacggtgttaaatctggcgggaggaagctttggggacctggctatccgtctgggagcgctggttctgtacgtgtcggggattgtggccacggtgctgattccgcgctacaccagatgggatttaaaaaacgtgagtctggcgctggacgcggcggccgtgatgatcctgggttttctgccccaggggatggacaacatgctggcgctctacccgctgtttttcgcgctgtcggtgcagtggtgtacgtttcaggggtgccggggttacgccagcgcgaccgtcttttccaccaacaatctgcgccagttcgccaccgcagtggcggcgttttactgcggccgcgaggagaagatgcgggaaaagatcaaattctacggcgccacgctggcggcgtttcacctgggggtcgcggcctcctggccttgctgtaatctggcgggagtgaagagcgcctggatctgcctggcgccgctggccgctgcgggatacctggcggcagccgggcggtcggaggaaggcgtgaagatctgcgaatgccggggtgaaggaggaaacgtccgcgggctggccgggtagcgggcggtgaagtcagagaagcgcggggaagaggtgccaaggcagggaaattatgcaaataagcaaagatacagatggcaaaagaacggagtcgcaccttcgatcttttgccatctgttctatatttatgcctccagatttcgttgctctaacgccagaccaatcaaccggtctgtctggtctgccataaataatgggatattcaacacatcgtcatccaacttcaggttatccaacgataaacggatccgcagctttacctgatccgggaaaagctccttaaacttctttagacttttgccggtggtattggtcccggacttgacctcaacagggaaaatgtcattctcccgctggatgaggaaatccacctcgtaaggaggattgttctgcgtccaataccggggaaccacttcaaactgcgtaatcaaagtctgcagtacaaagttctcggtcaatgcgcccttaaactcagtaaacagacgttttccttcaccaaaggcggttggcgccaaatgtgccagacggcggagcagacccacatccacaagataaatcttaaaggcagaaaggtcgtcataagccgccacaggcagcccaggcgctgagcttcggtagattttatgcaccagacgggcatcgaccagccactgtaaagcctcctcatattcacgggctcttgccccctctttgactactttgtagataaacttcttgttttccctcgccagctgagacggtatggacttccaaatcatcgaaatcttcgggtactcgctgatattggggagcttggcgaagtcacgttcgtatgagccgatgatcccggacagggcttcctgcatggcggaaacatcccgggcttccgtccacatcagaacggattccggcataccgccggtgacatagtacattttgagtttttcataaagcggattaaagaatgcgtcggggaccggctcaaggatgtccacagtttccagatactttgccagattctcatcgccgttggcgagcagaaactccgtaaaggtcataggatcaatctgcatgaagtttaccttgccaacagggaaagacgaaggcttcgccagtgcaattcccagcagtgaattttaatgcaacagactgcctgcccactttaaccactatgaaatttattagcaacttataatttcaaacctgtcttgtaaatccatagtatttttcctagaatgacatcgtgtccaagtctgttacaataacgattgaagggggattgttttaatgcagattgcatatctgggaattgtgtttttcatcataatcggactgttggccatgcgcaggccgttgtaccaggccattctgggcgggttggcggccacggccttgctctatcagatttcgcctgcgcagcttgtcctgcgaacctccctggtgatcaccaaatggtcgtctttgtccgttctgctgtcgctttatatgattacatttttacagcggattctggagtcacgaagtcaaatcaagctggcacagcgggatctcaacggaatttttcataatcggaggatcaataccgccggggcagccttatttatcgggctgctcccatctgccgcttctatgatcctatgcagcgagatcgtgaaggaggccacggacggatacttaaagccaaaggagcaggcatttgtggccagctggttccgccatattcccgagagcacgctgcccacctacacggctgtgctgctcatgctcaatctgtcgggagtggagatttccagatttctggtggggatgattgtgccggtggccactctggcaattctgggatacttcacgtatctgcggcggattcccaagactccgggggattcggcgggcggctcatgggccaggaacgcgctgcggcttttatcccatctgtggtcattgctgttgattcttgcgctgatcctcttcttcggattccaggtggtcacggcggcgctgatttccatagctgccgctgtgctggtctaccgggtgagacctggggaactgaagcttatgttcggctcggcttttgaaaagaagatgctgtccaataccttcctggttctggtgttgaaagaattcatcgattataccggagttttggttttgctgccggaggccatgtccgcgtttccgctgccgtcttacctgatttttgccctgctgttttttacggctacggtgatcagcggcgcgacgggagccattgccatgggtacaccgctggcgtttgcagccattcatggagggctgccgcttatggtctatttaatgtgcgtcacccacgccgccagtcagatttccccgacccacgtgtgcctggtggtggcctcggattattttcatgtgactctgggcgatctggttcgtaaaacgctaccggtatcactgctgttctgcgtgcttatgaccgcatactaccagctgctgctgttactttgaggcgttctcatcttatttgatatggaaaggcggtaaccgatgaattttcagactatggaatactttattgttttggcagaagagaagaactttacccgggccgctgcccggctgtacatcacacaacagtccctcagctcccatatcgcggcggtggaacaggagctgggctgcaggctgattattcgccaggtcccgctgggtctgacctacgcgggggagacatttctccgttacgctaccggctactggaacagctatctgacgatgcagcacgagttttgcgacattgccagaaaccagaccggaattttgcgggtgggtatatcctatacccgcagttatattttcatgccggacataatcgccgacttccagaagaagcggcccaacgtacaggtgaaggtctacgaggattccgatctgatcaaacagcttacggacggcaatctggatctggtcattaccaacttaaaggacaatctgcctaaaatcgagttcagggacttttacgaggagacaatcgtcatggcaatttccagaaagctgttggaacgcctggatttgcctgagaacgagatttccgccgccatacgggagggccacttaaacccattgaggcaatgcccctttgtgatgaacgaagcgggaggcttggctttcagcgtggcccaggagctgctggcccactctgattaccagccccgaattaagtgctccctcgtcaacatccggaccattttgcagctgtgtctccgggatgtgggcgcctgtttcgcacctgagagtatggtctattccatgctgagtccgaaacagctttccgggatcgccgtatttcccatcgacagcagtcttcgctgcaggatccggttcggatatctgaaacgggcctatcagtggagcctgatcgatgaatttatacagaccgcgctggcgttgtatccgcaggtcatacatgcctccggccccggcaactcgtaaagccgtatccatgccgggccggttctaccgcaagagcgggcagcagccggttccgccgtcaatttcatctgcgcgtctgcctttttgccggggaatcatatccccggcctttatgatggttaggccgcccaggaacagcgagacagccataaatccgtacagcaggttaaaattgccggtgatatcgcggatgaggccgggaaaaagactgaacgcggcggtcatgagctgggcgatggtgatgtagaccgagctgacggcgctgaaattttccaccccaaaggctcttaaaaccagggtttgggggccgatcaccgtgaagccgaaggagaatccgaacagcgctccaaagcagtaggcggccgtcggggacgagatgaagggcaccatggcgcaggtcgcggccaggagcaggatactggcgctgtacacatatttggggttccaccgtgccatggccacgccggacaacagccgcgtgaaaaagtttacaaaggcgtagatgctcagaaccatggaagcctgggtcagggacatacccttctcggtaaatgtggttacggagtaggcagtcacacagttgagactgaaattggtgcagatatacgcgaagacgatggcacagaatatgggcgtatgcataaattcacggtttttccagatcacggcccccgccccgtctgcccttgtcttcggttcgctgggttttataccgtcgggataagttcccatatcctccgggcggtcgcgtagaatcaagatggagaggaaaatgctcgccacgctgcccgccaggatcagtacccagacagaccgccagtttcccgtgtactccatcagaaagctggtcagggccggaaaaatgaatccgcccacggcgccgctggacagcaggattgccagaaccatgctgcgtttgcgctggaaccagttggataagatggcctgggaggccacgcccgatccgaaggtggccatggcggagagcagcatggtgcagcagaatatgtaccggggcatggtatccacgtaccagaccatcatcgcgctcccgatcgtcccggagatgccgccaagaattatcaccagcttagcgctgtatttagaaataatccaccccacggccagtgccagcagagcgcaggcgaaggcgttgctggttttcgccacggaggccatggtcattgtgcttccaaattcgttgatcatggaagagagcgtggtgccgtacgtgtagagccatccgcacagcaatacaaagtgcgtaaagcagagatataccagaataatccatccgtaaaacatcgtattgttcctcctgaggttccgtgttgcggaatccggcttcggatacctattaattatgaaaaccggctgcagatccgcagccggttttccgtttcatcgtgtcaggttgaagcgctattaggcgttgctgaaagtttctctactgtggcgcggttcatggcggtggcgcgctcgtcctcagcttcgtcgcccgaccagacagaggtacggatgctcacgtcggttccgctctttccgcggatataggatgcgaagctgagtactgcgattacaataatgttgccggccgccagcgcgggagaaagggacaggcaggtcttccagatggtgatgcaggacacgaacagggacaggcagcagcagctgtaatataccgggttgggtacgtgaaagcgggcacgtttccaggcgttggggtacagcttcggcatacggataaagccgaagaagtttaacagcatgaagaacgccacaatcagctgcaccagattcgtgagcgccacgatggacatctggaaaagaatggggattacgccgataatgtagaaaaaggtcagggctgtagcgggtgcgccgtgtttatttttgcgtccaagccacttgggcagccagccgtcggcgcagctctggctcacatccatcccgcggaccgcgaagctggtgttcagggtggagagaagggccataatggggccggcgatgatgaatacgataaagacagccggcgggaagatgcttctggctgcgaaaaccagggtggtggactggccgtattcttccagcgacagcgtgcccaccgccgcgatggcggagccgacgtaaaccagaatcagggttgggatgcaggccagcagaaccagcggtatgtcatgccggggattttttgcattgcgcccgtaaccggtgagggcgtaatagccgttgcaggaatagatgaacaacagcacggccccgaagaacccgccggaaatcaatcccttttcattgaaggtaactccccagccgttgatcagccagttgggatcattgaaatcaaagatgggcagcttgatttttgcgatgccgaccacggtgaagagcaggagggcggcgatcagcagccagaccatcagcttctgcaccttggccatgatattcatacccatcaggttgaccacataaaagaaggtgagcagggccacgcccatggccacacgagccccggaaccgcccaggatgggaaagatatcgcccagatacgccgcggcggacgtcccaaacagggagagtccaaagcactgggtcaggcataagaaggcgtacatgccgcccagccgggggcctcccagcccgtttaacagcgagtaggcgcctcctcccatgcgcagggtggaggagataaagaaatagggcaaaatcatgcatacacccataaaaattgcgaacaggtaagccagccaggcggaatagccggtcattttgatggcgggcacgatcagcgtgatgacgccggagccgattaccgtgccgatggcgattgcgtatagctcgggttttccaaaatccttaccgggagccggttccttttcgttaaataccttgattgccatttgattgcttcctttctgtttcgtaacccctgaaatcgtgtgtcatttgtatttgtttttactgaaccgtcactacatggctgcaccggtacgcttcctcggaaatctcgttgccgatgccaggcagatccgatacgatgaatttgccgttgaccggctcctcgttgcgcaccgccagattgaccagattgggcagcatgcagttcacattgtgctcatggatggtgaaattggggatagcgccctcaaattgcagggaggctgaggtgacaatgggtgtcccgcagcagtggatctgaacggtggactcgtagatataggccaggtcgcagattttcttaacctcggtgatcccgccgcaggtgcccagatctggctggatgacctgaattgcctcctgctgcagacatttattgtactgccagcgggtataaatccgctcgccgctggccacgggcaggccggtttcccggtgtacatagctgagtaaatcggcgtggggcgtggtcggctcctcatagtagaagatgcggtatttcttggccatattgcccatctgtactgcgccctgggcgtcggtgtagcagtggttttccaggataatgtccaccttggggccgacggcctggcgggtggcagctatgcggatttccagaagctccatacgctccgggtccagcaggccggtctgctccgtatccgggtagcgtgttccgtcctcccggtacataagataatcaattttgaccgcgtcgaagccctgttccacggccagcagagcttcccgggcgtaatcctccggggtacatgcattcctgcgcccaacgccctggccgttttgcagctggctggcataggctctgagcgtacttctctgtttgccgcccagcagctcgtggaggggagcctgatagaccttgcccttgatatcccacagcgcaatatcgatggcggaaatgcctccgaatacgatgggaccgccgttgatcccccagaagcacgcctcccggtaaagcttctgccagattacttcatgctgtaaaggattcattccgatgatctttccggccatctcctccaccatgctgaaggcggctttcgaggcgttgccgtaacccagggcaacttcgccgtcaccgtagatcccctcatccgtgtgaacccggatcaggacgggatgccaggaattttcgttagggtaggctctgagtacgtcgactttggtaattttcatataatatcctccattctttcagcctgtgccaaatgtctgtgtgcgattgtcacaggaagctgcgggttttgtgatttcattatagtaaatatgcctgaaaaagtataactgttgagatttgtagtttccacaaacagaacctgtggcagcggccgctccggtgcatccggcagaaaattatttcatataaggcatacgccgtgcaacggtcacaatgtttgcctttgcgatgcactcctctgtgggttcctgccccagtcctggcaggtctgggacctggtagactccatttaccggctggtagtcgtatttacaggtggcgcggttggtgggatttaaggcccgctgatggtgctcatgaatcagaaagttggggatcgccgcttcgatctgcagcgccgcagccttggaaatcgggcttccacacacatggatctgaacgctggcgtcgtacagccaggccatatcgcagatctttttggcctcggacaacccgccgcacaggcagagatccggctgaaccacatccaggagccgcttttcgaagaattcccggaagccctgcctcgtatagatccgctcgcctgaggcgatgggaattctcgttttctttttcaactcggtaaaattctccgggtttagcggatgcaccggttcctcataatagaaaatgcgcaggggttccagggcctccgcaatctggatcgccgccacggtgtccgtgttggagtgcatctcgatgatgatgtccagatcgtcgccgcctgcctcccgcatggcggccacccggtcgtaaaccgcgcggatcacgtgtttttgcaggggaccgcggatattccaggattttcctgaggaatccggaatgataatgggatcgacctttacggcgtcgtagccctcctccatggcgcgcagcgtcacctgggcgtactcctcaggctccatgagttcctgcttggtcagattggatccccagttgaactgaacctgactggcataagtgcgcagcttatggttggttttcccgccaagcagcatgtagatgggcacgcccagggcttttcccttgatgtccataagcgcgatgtcgatggcgctcatggcagcggaaaccaccgtgccgccgcccatgccccagaaggtcttgcggaatatggattcccagacctcctccgtattcaggggatccatgccgatgatctgttctgcgaaatcctggatcattcccagaccggcccgccagcccttaccgtaggccaggccggcctccccccagccgcagatgccttcatccgtattcacccggaccagaaccgggctccaggctccccgggtggtggccccgttgttgccactgggaagctgcatggcatcgatacttgtgattttcatgtattttatccttcctttgtgacatttgttttgacttatcccggaattaaagtatgcgcgcggcagattgtacaaagtttctgtacaaccaactgataccatggtataatactaacgcattttatggaattactttcttttttaagacctgttagccctgcgcctaacggcgtgcacaatcttaaatggaggcgttatggaactacttcagctgcggtattttgccgaacttgcttacacggagcatctgtccaggacagcggaaaagctgatgatttctccaccgtccctgagtagtaccatcaagaagctggagaacgagctgggggttcagctttttgaccggactcatcagcagatgcgcctcaatcagaacggccagcttttttaccgctatgtgcaaaacgcgctcaacagcctggattacggcgtcacggcgctcagacagaccggacgccccgttctcaaaattgcgatgaccagctatccggtgtggattgacctgatctacgcttacgagcaggcatatcccggcgtgctgctggagtacgcggtgatctcgctggaggagcttcaggcccagcgcacgcccttcccgtggaattttttcctggggattacggaggatatggatccggcttattttcagtcccggaaggtgtttccgccggagcggccggttgtcctgatgtccgtagaccacccccttgccggccgttcccagatcaggctggaagagcttaaggatgaaaattttgtctctgttggaaaggcgaattcctcggcccacaattatatgatgtctctgtgccggctggcggggtttgagcctaagaaaatctattacggggattatctgatgcgggtcaagcttatcgagcagaacaggggcgttaatatcaccaccaagctgggggccacggtaaacgcaattcctctggaaacggtcaccaccatccccttgtcctcgccgatcatgacgcggacccaggcagtgggttgggaaaaggacaggctgttatccaaaacggagcaggaatttatagatttcgtggtccggtatttcagggaacatccgcctatggatcctgatatgctgggataatggagcgtcataaaacgtaaaataccaaatgatatggaaacggagcgaaagagcgtgaaatacgagcctaaaatagaaaaagagattatgtgtcccattgaatacggccttgatatttttggaggaaaatggaaatccagaattatctgcgtcctgtcatcccaggatgcgatgcgctacagtgaagtgaggaaaaaactgaacaatataacagacgcagtgttggccgctatgttgaaagagctgatggaggaccggatcatcagtcggacccagtacaatgagatccctcccagggtggagtattccctgacggatcaaggccggtccgtgctgcccattttgcagagcatttgcgcctggtccaggcagtacactccagaaagtctggagaagaagctgccgccctgccagacgtgtccgcagctatgaaaattagtagcggctcataaaaaacttaatatgttgttcatgatgagcggctctgttagaatgagcgtgtagtcgaaatacgaaatcattttaacggaggtactcagatgaaggtaaatgcttatcttgaaatcacaatgaaaatcgacgaaatcaaccgtcccgcggctgcaaaggtatatatggattaccgcgggccgtttctgcagacaatttccggggccctgaccaaggatttgctgatccgggatgaggatgtccaggtgcttcacggatttgacagcacagagcatgcccgtgcctatctggagagcgcaatgtttcagaacgacgtgtttgttggcttgaaacccctttggtcggcagagccggaagtgaggatttacgcggtggcgtagtatgttttaagaagaggattcgttacggatgaaacgcctgtgcggcagataaccgcatgggcgtttgccatatggcgtcttgcagcggtgaagctggtgccgggcgatatgcggacagcctgtttccgttgcttcctcctcttccagatgctataatagaccgatcacagccacccgcgtcccttcagggcgcggtgcatcaaccgatcaacaggggggataacgcacatgaaattacaagttcttgtggacaacaatacgtttatagactgctactatctgggcgagccgggagccagctactacatagaggacggcccggcaaagattctcttcgatacgggatactcagacattttcatcaaaaacgcagaggacatggggatagacctgggagcgatcacccacctcgtcctgtcccacggacacaacgaccacaccggcgggctgaaagccctggcggagcgctttgatctttcccaaacccgtctcatcgcccacccgctctgcttcgcgcccaaatgggcccacgagggctacatcggcgcgcccttcgacaccgcgcaggttatgggaaaattttcctgtaccctgacccatgagccgtactggattacggaaaactgctgttttctcggggagattccggagtcaaacgactttgagagccggcggaagctgggggaaatggacgtggacagcagtagagtggacgattttctgctggacgacacggccatggcaatccgcaccggcgaggggattttcatcattaccggctgttcccacagcggaatctgcaacatcgtagaacaggcgaaaaaggtgttcgacacccaaaaaatcgccggaatcatcggcggcttccacctgtttaagacggacgagcggttggagcggaccatcgattatctctgcggcctcgccgctccccacatgtatccctgccactgcgtttccctgaaagccaaggcggagatgatgaagcggatggacgtggaggaggtgggggtggggcttgcactggaacagcctccggcgttttcttcatcagattgatttctgattgacggatgaatcaaactgtgttaatctctaaatagaataggtcggtcgtttgaactaaaactaaataaaggggtgtagctattttgaaaaaacgaaatggtcttatttttgcatctgttttggtagttgtgttctacgttctggcctgttcaatgaaacttggggaggactctgtcctctcagcggcgtcctttgtgtatgcaggtgtgtttctggcagtgatcgtcctgcttctcacaggagctttggccgactgggtggtggttctgggggcttcgtccctgatgatcctgactgacgcggtgttccgtaaggtaggaatcatgacagagccggtgtttaccatgcccggtcttttcggcgcgttcagcggttccacggtctggctggtgattatggtgtttgcgctctccgcgggaatcggcaagagcggtctgttgaaccggattgccatcgccattctgtctgtattcccgcccagctataccggggcggtggtggcgatgatgtgtaccggcaccgtgctcagccctctgatcccgtcagtcaacgcaaaggtcaacattctcattccatttgccacgtccaccacggaggagatgggtataaagccccgtagcaagggcgcgctggggctgttcacagcctgttatctgccggcttatctgggtggcaacgcatttctcaccggctcggtctatgtctccgtgatctgcggctttatcacgtcctacgcggcagcacttggagtggaaggcgcatcctttaattttgtcagctggctggtggctgcaagtgtctggtttgtggtactgctcgccggcaccttcctgttctgtgcggttctatgccgtccggcagagaaggtggagttttccaggacattctttaaggaccgcttaaaggagatgggggccatgaggcgtgacgagaagattgccggggcgatactggtcatcgcgctgttgttgtggtccacctccagctttcatggcatggacacggccatgatcggctgggcggcaatctgcgtgatgtgcgccaccgggctgctggcgccctcggatttcaacacaaagattccctggtccctggtggtgttcattggaagcctgctgggcatggccaattacatgtccactcttggctggagcgatgccatcgcaggcgttttaggaccgattttggcgcccctggtggccagcccctggatttttgtgcccttcatctgcattttcacctacctactgcgtttccttatcatcgagcagaacacagctttggtggtggtgatggcgattttcggcgggctcatgcacgcggcgggtatgaacctctatgtgattattttcacggagtttatgagctccatgtgctggaccgtgccgtatatgaatcccttcgccatggcgactctgggagtggcgggcggaaaatacgtgaccttcccggagatgcgcagggcctctatcctctacatggcgatcaatctggtcggctgtaccgctagcatcccgctgtggtacgcgctgggcttcctgcactgactacggtaggaaacgggcgggaaacggcggcttgtatcggtggggtgaaaatgttataatggggatcagaagccgtaaaaagcaggaaaatccaccagtaggaggaaacccggccccatagctttgggccggtctaaatgaaaactatggacattatcgaaattgagtttaaagataccgatactacgccggaccgcctgatcaaagccacccaggccctgatcgcggtatacggctacgatgccactactacgcgtatgatagccaacctggccaaagtgacgctctccgccatcaattttcatttcggcaacaaggagaatctggtccgggaggccatgtccagggcagcccaggagctggagctgcattattctaagctggccggggagatccgccggtttctggaggaggagccggttgaccgggaaaaggcctggtcctacctggaccggattctcacggaccggattcgccgggcctttgaccgccgggccagctggatcaacatcggcattgcggaacatgagaacggactcccggagagctccagaggaatcatggcccgcactgcggttgaggggagcgaacggattctggcggagctgatcctggcggtcagcgacaagaaaaacgcctttcaggccgcgctcatttcccgtgcggtcaacgcggccattatgagctattcggagaagccgctgctcaaccaatatctggaggagtccctcggcgtggatttgagcgatccccggcgggtggaggagtgcctccacgattattttatgacgagcatcgccgctgcggtggtggtggacccacacaaaaagatcgtataagaccgtgagaattgtgaaaaaatgccaataaaatgtttggggaactattatttatgtaaaaagtgaaacattctattgacaaaaaattctcaatatagtatgctacaattaaatcaaacgaccgacctaatccttttacccatcgatgcctttcccgcataacagtctgttttcaggaaggcatttccttttcaacaaaataggtcaaacgactgacctagtccattgcatgcagacacagaggaaacaaaaaacgtaactgttcaggacggctcatcttcttgacacggcttcccgagccaatttccccgccgtcctgaacggttaccccaaaatatgtttggaggaacagaatatggagaaacaaaccatcagcctgacggtcaacgggcagccctacgagtttctgatcggagagaaattcggcatgatcccgccgtcggagaccctggttcagacactgcgcaggcggcttgaactgacagggaccaaggaatcctgcgacgagggggcctgcggctgctgtacggtgatcaaggacggcaaggccgtggccagctgcatgatcctaaccgtggagtgcgacggcagcgacattctcaccatcgaaggtcttgaaaacacggtaactcacgagctggacccgatccagcagaaattcatcagctgctattccttccagtgcggctactgcacgccgggaattatcatgagcgccaaagcgctgtttatggaaaatcctcatcccaccggggaggagatccgggaggctctggcgggcaattactgccggtgcatcagccattacactgtgttggaagccctggataagctggcgggcgtggagtccgatcagtatgagatcgtaaaggaggccgaggaagaaaatgactgactataaaagaggaaaattcaactttgaggcgccggtagtcaatggccgtcccgctccctaccgccatgttggcaagtaccgtgtgcgcgcggacgcccgggatattgttaccggaaaatgtctgtttctggacgatttctcagtcccccgcatgatttacgcccaggtgttaagaagcccttacgcccacgccagaatcaaacgcatcgatacggagaaggccctggccctgaccggagtacatgcggtaattacatacaaggatatgcccaaaggctggaccctgggctggccgccccacaaggacctgatggatcaggaggtttactttgccggcgatccggtggcggtgtgcgcggcggataccgtggatatcgcccgggaagctctccatctggtcgaagtggagtacgaggtccttcccgcagtctttgacgccatggatgcactaaaggaagacgctccggttctgttcccgggaaagtttaagagcggcaccaacgaggtggaccccggcgtgccccatttccagcccgaagggccgtggtggaaggtggagggcggagatgttgagaagggatttgaggaatccgcctatatcggcgacagcctggtggagttcaacaagatgtgttctcccaacgcgccggaagcccccggatgtattgtgcgctgggaaggcgcttcagactatacgatctgggcctcctcacagtcgccctttatctgcaagctgttcaacggtccccgcatccccaagtccaacctgcgggtgaaaaccttcaatgtgggcggctcctacggcaataagcagacgctgtcctccaccattctctgttgcgccatcgcggctattaagaccgggcgtccggtgaagctggtcatgagcaagcacgaacagctggtggctcacgagcagcgcctgggctccaagatccgtgccaggatcggtatgactgaggacggcattttcaacgcggtccagggctgttggtatgtggacacgggcgcgctgtgcgacgcggttcagggacaggtcggggtaggcctgggagaggcccagctggtgatggcaaaatgtaaaaactgggatttggacagcaaggtggtggtcaccaacaaatgcccggcaggcatcgtccgcggatacggcggacaggagttaaacagctgcctggcgcgggtgatgtcccactgcatgatgctggcggacaaagaccccattgacatattcaaaaagaattacgtgtccccaggcgataaatatgtttggcgagacggcctggtgtggcagagccgcggctccgaccattatccggccaccatgcagatggcggcggataaattcggctgggatgaagcctggaacggatggctgaaacccaccagggtggaggggcgcaaggcttacggcgttggtgctggaatcattggaaatgccgacgtgtgcgaggacaacacgcagtgtcttgtccgaatccagcacgatgtgaagggcaggggagccaccctgattgtccagaccgatattacggagtcgggcatgggacagcgggccgcggccgcaaagttcgccgccgaggtcatgaacgtgcccattgaaaaggtttacgtcacggagccggattccctgaacaatgtggtgaacttcggactgtgcggctccagaggcacggttacggtgggcaaggcggtcaccaaggcggccgcggatgccaaacgaaaggtgctggagatgggcgctctgcatttccactgttcaccggaacagctggagacaaaggacttccaggtgtttgtccgcgacaacccacagaagagtatccccatcaagaaactggggcccaaggatttaaatgttatcggatacggcgagcatgtggagcagtttgatattcccagctgctgcctgtttttgaccgaggtggaggtggacctggacaccggggaagtgaaggtgctgcgttttactcaggggaccgatatcggccagatcatcgacaaccggatgatccgtatgcagctgcagggaggcgtgggttccgcgtctctggacaccgctaccatggaggagtgcatctacgacgtgaacggcacgggtaagctgctgaccaacagcatgctggaatacaagtgtcgtaccttcaacgacatgccgaaacacaactgtgtgatcgaggagagccagctggataccttcatgttcaaggctgtgggcatcggcgagatctcaggagccgccggcgcatccgcggttctgatggccatttccaatgccatcggcgtggaggtgaacgagtatccggccaccccggatgtgattctgaaggcaatgaggagcaaggagggaaaataaattatgaagcattttaaatatcaggctcccggctcatatgaggaggccgggaacatagtacgggaggccagaccgggcacaactgcggtgatggccggaggtacggacctccttggcgtattgaagggagaactgctcccggaatacccggagaccatagtggcgctgcgggatatcccagatacggattatatcaaacgggaagacaatctggtgaagatcggctccatgacccgtctggcggccattgagaagagcggagtctttgacggggagctgcgggcggtgtcccaggcggcccacagcgtggccagcccgttgatccgcaaccgggctaccatcggaggaaatctctgccaggatgtgcgctgctggttttaccggttcccggatcaggcaggcggcactttggactgtatgcgaaagggcgggagcgaatgttacgcgatccgcggcgacaaccgctaccactcggtattcgggggaatgaaagccgggatcacgccttgctcggcggagtgtccggccaacacggacataccggcctatatggcccggtaccgcgccggggacatggagggagcggcccgcattctgatgcaggccaacccgctgcccatgatgaccagccgggtatgcgcccacacctgccaggtgaagtgcaaccggtgttccacggatgaggcggtcgccatccacagtgtggagcgcgtggtgggcgattacattatggaacaccgggaacagttttacagcgcgccgaatcaggagaccggtaaaaagatcgccctggtgggcgccggaccggcgggactgaccgcggcctactatctgcgccaggccgggcacagcgttaaagtttatgaggcccaggaggaggcagggggctgcctgatgtatgcgattcccaatttccgcctgcccaagacgtatgtgcgtaccgtaatcagggctctggagcaaatgggcgtacagtttgtctgcaatgcaaagctgggagagaacgttaaaatcagcgatctgacggcggaatacgacaaggtgtttatcgccaccggcgcctggaagcggcctgtgttgggattcgacggcgaggaattcacggagtttggcctgcaattcctggtcgatgtcaataaatgggtgaactccaaggaacgaaacaatgtgctggtagtgggcggcggaaacgtctccatggatgtagccatcacggcaaagcgcctgggcgcaaagcgcgtgaccctgtgctgcctggaacagcgcgaagagatgccggcgtccgcagaggagatcgcccgggcggaggaggaaggaatcgagatccgcaacggatgggggccggtgagggccctgtacgacggttccagtctgaccggtatggagctcaaggcctgcacagcgcttcgggacgagacaggacgttttaatcccagctacgatgagaaccttcggatcacggtggacgcggacagcatcctgctggccaccggacagcgggtggatttgagtttcctggaaaatgaactggaactggctgtaaaccgagggctgatctcggtggaggccgagacccaaaggtccagcgatcccaaggtgtatgcgggcggagacgccgtaaccggccccaccacagtaatcaaggccatcgcctccgggcggcgggccgctgaggccatcaacaacgagatgggagttggaaatcccgtcaagaccacccagacgggcctgatccattttgacacggccacggctcgtctaaaaaaggccaacaacggccacgacttatccgcagccgaacgctgtttggatcgggaggacagcacctccctgactgcaggggagggccttgaggaggcgaagcgctgcatgaactgcggctgctacagcgtcaatgccagcgatttgtcccctgtgatggtagcgctggacgccaacatcaaaaccagcatgggcaggctgattcccgcggcagactttttctgcaccaacttaaagtcctatgccaatctggagcccggggagctgattgtagagatcgatattccggtaaaagagggctatcggaccggatatgagaaattccgcatgcgccccacccttgatttcgccatggccgctctctgctgggcttataaaatggacggatgcagaatcggagatatccgcctggtgctgggcgcggtcgcgccggtaccgcttcgtctcccggaggttgagcagtatctgatcggaaagaaaccgtcgatccaggtagcgtcagaggccggggagctggccgttaagggcgcccagtccattggacacaacgattacaagatcgatgagatcaggacgtttgtgcgtcggctggtggagtccatgatctgaatcaggactgagaagaaggaggtttatagatgtttacgaaaatctgtaccgccgccgaggcggccgcattgataaaggacggcgcgtttttaacctgcgcgggtaatatgcacaactgtctggcggaggaaatctgcgccgccattgagagccgttttgtggagagcggacacccggcgggaatgacgatcatgtcggcctcaggggtgggagacatgggacctgtgggcggcgtgttccgggggtttgaacactttgcccacgacgggatgattaagcgcgtgatcgtggggcacaacggttccaatcactccattatggagatgcaggccaatctgaaggtggagtcctacaattttccccagggcgtgatcgagcatatgttcaaagcgcgggccagaggcctggatgtggagctttccaaggtgggaatcggcacatttgccgatccacgcctggagggtggaaaagccaattccatcaccaccgaggagctggtggaggtagtaaacgttatgggcggggaatacctggcctataagacgccgaaaatcgatgtggccctgatccggggtaccacggcagacgaggacggcaacctgacctgcgaggacgaggccgttctgaccaacattcaggccattgccatggctgcaaaggcatccggcggcatcgtgctgtgccaggtgaaaaatgtggtaaaaaagggcgctcttccggccaaggaggtggtggttcccggcgtgttcatcgacaagctcatcgtctgcacggaccttgagaagaaccaccggatgaccatgggcgagtattacaatcccgcttacacaggcaagttcaagtatccggtatccgccgctgcagcgcttccgctgggagtgaagaagaccatcgcccgccgggcggctcaggagctgaagctccatgtcccggtgaacaccgggctaggttatcccgagggcatctcatccgtagccaacgaggaggggattgccggggacctggtgctgaccgtggaaaccggcgcctttggcggcgtgcctgccgccaggacttccttcggggcaaccaccaatgccctggcctttgtggacagtcccacgatatttgacctgtacgacagcggctttttatacgccacctttgtgggtctggcggaatgcgatgcccgcggttcggtgaatgtgtcgcggtttacggacaaatcagggcgggagagaaggcccggggcgggtggattcatcaatctgactcagggcgcgaaaaacgtgatcttctgcggaaccatgacggccggaggttacaaggcggagatccgggacggaaagctggtgatccttcaggaaggcgcggagaagaaattcctcaaccagatcaaccagatcacattctcaggcccccatgcggtggacatcaaccagaacgtgctctatgtcacagaccgctgcgtattccgtctgacggcggaaggactgaagctgatggaagtggcgccgggaatcgacattgagacacagatactgccctacatggagtttaagcctatcatcggggacgacgtgcgggaaatggaccccggaattttccggaatgggctgattggactgcgagaaaccatcgaatcgaaggccgaatagggccgggcagccctgcccgcgctgccttcaggagggcggggctgcacaaaaacagcgatctgtgaccaaaaaggagcgtatcatgagcgagcgatggtcggatgtcctggctggacgtcctgatctgtttcaaacaaattcaatcattggcctgttccggctggccgcggaacagaagcccggccacaccgcggcagcggatgaacagagccgccttacatactgtcagttggagcagaggagcaatcaagccgcccgggcgctgtgggaagccggagcgcggcccggggagatcgtcgcggtcagaaccgggcgcagcgtggagtcggtggtggcgtttctgggcatctggaaaatcgggtgcgcctacctgttcctggacgacgactgcccggcttaccgcaatcaggagtgtcttctggactgtcaggtgagcgttcaggtggacagagatttcatctggcgcgcggtggaaacgcagtccgacgcggcggtggaggaaatgggggacagggaccggctggccgtgatcgtgtacaccagcgggtcctgtggaaaacccaagggggtgcagctctcccatgccaatattgcggcctccatctccaatttcccggagatcggtttcaccagcggcgaccggtactgctgcttcgccaacctgatgtttgtggccgcggtctatgacatggccatggcgctgtccatcggcgctgctctgtatctgatccccggcagaatccgccgcaatatccgggagattgccgattactaccgggaagagggcattaccgtgacctttctgccccctcatatggccatgaaatatatggccattgatcaagaaagcccgctgagaatcctgctctccggcagcgaacccgtgcgcaacctggacagaaggccctatgacctgatcaacgtctatgccagcagcgaggcctgcgccctgatcagctattaccgggtccgggacaaacgcaagtcgtaccccatcggccgggtggtttccgcgctgcggtattatattgtggacgaggagggagcgcaagtggctggaaatgaacccggggagctgtggatctccggccctcaggtaacccggggctaccggaatatgccggagctgaaccgggagcgtttctgccctaatccattttgtggggaagcgccctacgaccgggtgtttaagaccggcgatatggtggcggccgggaaggacaaggagctggtttacctggggcggcgggacaatatggtgaagatccggggcttcagggtggagctggcgggcgttgagcggtgcatgatccagttcccggggatgagggaggtgtgctgcgtggcgcacagagacagcggcggaaccaacctgctgttcggatattacatcgcggaccgggagatcgaccatgagaagctgcgggtgtatctgaaagattaccttccctattacatgatcccgtcagccctgatccgctgtgaggaatttccgcgcacgctgtcggggaaggtgaaccgccgggccttcgtccctccggcagagctggacgaccacaaacagattgaacaactttatcgatgacgggaggaaccgtatgccgaattttaactatgtaaatccaaccaatattcacggcggcggaatgcagaccggggaggaacggctgttctccattgtattggacgcgctggcctacgacgggtatcagaatatgacgttagagggaatcctgagccggggggcggacccggagacggtaggccggtatgaatcctgggaggcgctttgcgagcgcgccctgacggatgcggcggagcgggtcacattggcctatgagtccgccacggagggggcgagggcttatctgagcgcagccggacgcagccgcgacgagggattaaagcagctggagcgcttgctttaccgccatatttacctgtgtttccaccctaaaaacaggagctacgttctggcggcggcgggggagagccagcttccgcagcggctgcagcggattctgccggatgccctgcaccggcagttcggctcggtcctcgcagagttgatcacgtcggtcagcgaggtgaagaacgcccagatgtccgccatgatggcatgttccatctgcggcgccgtcaacattttcgtccagcagcccatatactgccggaatctgtttgtgagggagaccagggaaaaacccaactacgcggtgatagaggattacctgaacaactattttctacgcgcggttgtggcaaacacggccattaataagctattttaggggacaggagtgtgagtatggagcggacaggaaccgtggaggcgaaggccttaaaggaggcctggcaggagggatatgaagcggcgatcagcaaaatgcggctggcgtttaagctgcgggacatgggaatagcggactgcgagattgtgaaacggacggatctgcctccgtttattgtccatggcatgttgggagagcgggaggccggccgttaatccggccgacccgctttccaggctttcagttcgcctgcgcggtgggaggcgtagctggacagcgcgtttttcagggcaagggtggcgatgacggcggcatagtaggcgtcgtcttcaagggactgtccgtcggatatggcggaggcgatgtccgacggcccaagaagctgggcggccatgacggctttttggtgggccaggcagcagagaatggcggcgcaggcggcaaaagccggcgggcaggtttcatccgccgtgtatccgatggaggtgatgatgtcccgttcggccgcaaaggcgatggataacagacgcctgccgtccgggccggtgatctcccccagagcctgaagggttccgggaatctgccgccagtcccgggaggaagcgtaagtttcaagtgttgtcagtgttatggccattgagacaggtctcctttgtttggattaggtcaaatgacctatgcgttatgtctattatagatgaaataccggaacttgtcaattcggaaactggatgaggatggagcgtgattgtgagatggagcgtgagataaaagaacataaggtggtggagcagattccctggcgggaaacatgttttggctgcaacgacggcgccagcgaaggggtgggcatgcgggcctacatgaccgacgacggctatgtggttggcctttgcagggccaaaacagagcatcagggattcccggacacggttcacggcggtataatcgccacctattttgacgaggttctgtggcatgccacccggatcggagattcggagacaatcgcgatgacggtggagattaaggtgacgtatttaagaccggtgggcatcggacaggagctgcggatcgtggcggagccggcgcgggtggaaggaaggcatatctatgtggacggattccttttactggaggacggccagacggcggcgaaggctttggcccattacattgcactgcgtccggaaaacggtttaaaccagacggaaatctgccgggtgaagcaccctcagacgtccggaccagagacggtccgcttttgaaaatgagtacaggaggaacgatcatgagcgagtgggagcagaaggtggaggaacagcggattacactggtggacagtcaggatgaggagtataatttcctgattctggatgagttccggtacaacgaaaagcagtatctggctttggcctcctgcgatgaaaagacggatacgggcagtggaaacgatcccggcgaggcgaatgatatcaccgtggtgcgggtaggggaggccgccgggcagcccatgttgtttgccgttacaaatgcggatgaactttacggggttgcaaagctggtggaggagcgtttcggacatctgggcggcacggtgtaaaaaacggccggttcgattctctgagaggaggggatgagcttgaagaaaacaggtgctgtgctggctgcggccggactgtcgtcccgcatgaaggctttcaaacccatgctgccctttggcggcacgaccatatcccgtcatctgacggccctgatcaaatccctgggcgtagatccggtggtggttgtgaccggatacagaggggaggagctggaatcccatctgtccgcaactggcgtacgctttgtgcgaaatgaacggtttcgggagacacagatgtttgagtccgtgaagtttggaatccaatcggttctgggggagtgtgagcgggtcctgatcatgccgatggaccttccagccatccaaccggaaacctttgaacaggtactaaataccgaagggcgggcggtgcgcacgtcctgcgcgggggaacccggccatccgcttatagtggacgtcgcgctggcaggacagctgtgccgctataagggggaaggcgggctgagaggggcgattgaacattcgggagtgccggtgacagaggtggaagtggacgatgtaggcgtgtttcgggacgtggataccggagaggaatatcagaaactgttggtggaattgctgaggcaggattcaaaggcagggtgagacgtatgcggaatttgtatttggtgcgccatggaatggttgcgtttccggggggagtcaagcggtgtatcggcaggacagatcttttcctggacgatacagggcgcaggcaggcggcggatttgggccggtattttctgggcagacgggatttgcaggtattctgcagcccgttggcgcgggccagggaaaccgccctcatcctgtcccgggggcgtttgccggtacaggtcgtggacggcctggctgagctggatatgggggagtgggagaattgccccatggctgagttgaagaaagagctggagtcggaaccggtaaacggcgagggcagggaaagcggcctgaaacggtttcgggaaaccattcatgaaattctggaaagcacaaagggggatattatctgcgtgacccatgcgggcgtcaactgctgttatctggcggatctgctggaaagtccgctgaatacgtccagagccctggcgcagccttatggctgtttcagccggattgagatagatgagagcggagggatgactgtagtggagctggggcggatgccggggaccgcgccggaccgggtggaatgtgagcggattttggaacattaccgcacgccggagcaggtgagggcccattgccgtcaggtgtgccgtcaggcgctgctgttgggcgggaaattaaaaaaagccgggtatcaggtggatctgggtctggtccaaagcgcagccctgcttcacgatgtggcgcgtgcaaaggcggatcacgcggtccagggcgctcagtggattttgcgggaggggtatccccaggtggcggaaatcattatgcgccaccacgatctgggaaatcccagctcccatccctacgagaccaccatcgtctatctgacggataagctggttcagggggaccgggtggtaaatctggaagagcgtttccaacacagccggagccgctgccagggatccgggtacccggaggaggccctgaaagcccacgaacgacgctacagggaagcacgggaggccatgggcagagtgcgggaatggattggagtggaaaatatcagcggactgacagggtgatgaagccctggcagtcctttttttaccttaaaacccgggaccgcagccttttttctcaggttctcctgcccccatcctctccattccccataaaccggcgcccacctgctaatataaacccagagccggagcgcatccaaaggctgcgcctggactcaatattaataagggaaggtaaaatgtatgaaaggaggagctttatgaaaatcacagggatcggttcgggggatctgatgaccggctttgcaggacatgagaaattttcatcggcaagaaatgcgggcagcccatctataaacttctgggcggaaaacaggataagatgaaggcatactgctcctgtggagcccgcatcagcgcggaggagagggccgagaaggcaaaaccggctgatcttccgccggagatgcgaggcggctgcccggaattctttccgggcagccgtattgtcgtggcaccggtatacgcatgccgctatttctcctcatccagcaacccaccatactcgacctcaggcatcggccggtagaacacatacccctgaacatagtcgcagccgatctttttcaggtactcgacctgctccatggactcgataccctcggccacggtacgcatgtcgaatttctttaccagctccacgatgctctccaccagcgccatatcccggttgcggtccgttccgtccgcaaagaagaagctgtcgatcttcaatacgtccacgggcagttcctttaacaggctcagggaggagtagcccttgccgaaatcgtcgatggagcaggtgaaacccgccgccttcagctgattgaccgtgcgcagcagcagcgaagagttgtcaaaggcgatggattccgtgaactctacctcgatcagctccgccggtatatcgtaccggttccggatggccacgtagttctccacaaaattcaggtcgttgaactgaagccgggagacgttgacggataccggcagcacccgctttccggcgtccagccggcttttgagccaccggcacacgtcctcgaacacatactggtccagccggtcgatcataaatttccgttcaaacacggggataaaacggtccggcgggatgatggtgccgccctgggaacgccagcggaccagggcctccgcacagccgatccggccggtgcgaaggtccactttgggttggtagtagacggtaaactcccggttttcaagggcggctgacatccggctctcgatgtccttctcagcccacagatgacggcggatgctctcgtcataatacgtgtaattggtattctccccggtcttgacggttttgcgcgcaaagttggcccggtccagaaaaccgtcgatattcaggggttcgatcacgtcctccacacaacagatgccgcagcaggtggggagcagctggccgtgatgggcgctgttcatgaacgtgaggacctcccggtccgctgccagctgacggtctgcgatctctctccgatcctcatagcgcagcaacagcacaaagttgtccgccgatattcggccgcagatttcatgctcccgcagacccctaagaataatctggccgtaccgggagaggagttcgtccccgtaatgataaccgaagatatcattgacgtatttaaaatcagaaaaatccgtgtatacgatggcaaattttgcaggtacggtatttagcagccgctgggcttcctctttaaaacagtcgatccgatagacaccggtgagcgtgtcccggcgggtcagatcgctcagcttttcattttgaagctccagtttcagcaggtttttggaatttgcccagaagataaagccccaggtgagagacatgatccccaccataaccaggcagatggccagcagaaaatgcatctgacgggccgcgtaggcgtcggcggagaaaaccgtgttgttggcctgctcgaagtacgtctcgctgagggccagaagccggtcgccgtctcctgttccctggcggtaattgccgatctccgtcttgatctctttccacgtctcttccagtttggacagatcgtttaagtagccgggatcatcgggaaccggcagcccatatctggctgtgccgccctgcagctccgtcagaatgccgtccagataatcgatcaggggatcgttgggggtgccggacagctccagcttcaccagccgttgggtggcaccccggacaatccccacatagttgatgagccgtccgttggtctgggattggatcaatgtgtggatcgtgacgccgctgaacagaaaaagcagcagaaacagggtgattagcccgctcttaaaaaaacgcttcatcggaatttgcctctcacagccgaagctgtctttcgaaagaaattgaccagctttaacaaagaaccttgttcatataaatacctttattgtatcagaatgaatgccctattgcaagaatatggatcatatatcagatccttttatttcagggagttttccccggtgacaaggagccggatcacaggagtcatccgcagttcctccggcgggaggccattctccagcagatactgctcggtcaaggtaatctgtctgaaggtataggcttttatggcccgggcgcagtttacagcgtcgtccgtggagaggctttgaaacatttcacgggcgaatcccagggtgacctgaatgaattcaggggagatttcgcgggacgccttcagcggatagccccagagaaacaggacgtaaatgcggccgtaaatctcccgtattccccgcagcgggctgtatttggtgatgaacagcaggaagcgccagagggtcagctcgctgcgcccgtattccatgtcctcccgcagcagctgtaaaagccggtctttttcctcacgggaggccttggtgagcgtgtcccgcagcacctgctcacaggagtgggccagcagctcgaaggactggacaaagtaggccagattgcggcggacggccaggctggaaaaatccggggcctcacagcgcgctccgatgccgtatatccgggttccctttccgttgatcgaccgggcggctcccagctcattgagcactttgacggtgcggcggatcgtgctgacggaaacgccgtatcgccgggacattttctcgtaggatggaaaaaaggacgcctggctgtaagcgccgacatagatttcatgcagcaggtgcgacgccagactgtagcagacctgagggcggtcccggtagatccgccagacaaagggaatctgctccttgtccggcgcgggggaaatcccctgggtgatctgatccaccgcctttcccacggaaatccggcggaagtcccagagacattccgcgagccggtcccagtctccggccccggctaaccgtaggcagcgcttcatggacttgtgcagcatattcaggtcgttgagggaatccgcctcgttgggcttcaggaaaagcaaaccccagtagagggaggcctcccagtacaggttcattgccagcgggttatcaatccgctgcaggacaaagcagaagaaatgcagcacatcatcgtaggtggtcccgtccgccaggcgggcgaggtatgccagatcttccggtccggcctggcggaatccctccaccagcagcggcattaagatcatgcccgacgactggtaaaggtcctgagagtcccggacccggagggaaaaataacggaatatatgttcctgcgcccgctccggatcctgtttgaatatgatccttgtggctctgccgttatgcatgtcgatatagccctccgcgcgcaggcgctgcagggctattttcacggtctgagcggaaacatccagttcctgacagagcgtttcgatggagggaaggtaatccccgcactgatagtaaccgaattgaatccgcataaaaaagtactcgtaaaccagattcgagtattgctgttcactccgcaagttatgttcgcctccgcaaaaaaatagtatgcgttttcagtttaacatttttgcggcgtattttccataagcgattgagtttttttgcgatttggattataattgtatttcaaacataataacatgaacaaggatgaaaaaccggatggtccggtgccaaaagaggtgatagtttgaacggaaaagaaacaattctgatcgcggacgacggggagatcaaccgcgccatactgcggaacttattcgaggatgattacaatctgctggaggcggagaacggagagcaggccctcatattgctgcggcaataccgggaacgcatcgcggcggtccttctggaccttgtgatgccggagaaggacggttacgaggtgttgcgggagatgggggaggacaagcgcctctatcacgcgccggtcattgtgatcaccgcggacgacagcctgggcagccgggccagggtgttccggctgggggcgtcggatgtgattaccaagccctttgatcccgatgaggtcaaaaaccgtgtgaagaatattaccgagctgggccgctaccggcggcagctggagactatggtggcggagcagtccgcccgggccagggaggccaacgccgccatcatcgacatgctctcatccgtcatcgagtaccgaagcctggaatccggccagcacatccgccgcattcggatgtttacgcgcattctgctggaggacgtggcggagaattatcaggtttacaacttagacgccaggaagattcagctgattacagatgcctcttccctccacgatatcggaaagatcgccattccggacagcatcctcaacaagccgggccggttgacctcggatgaatttgagattatgaaagcccataccctaaagggctgcgagctgctctctgacctggaccggctgagggatcaggagtatttcgagtacgcttatcagatctgccgctaccaccacgagcgatgggacggcaggggatatccggacggcctgaagggggacagcatccccatctgcgcccaggtggtagccatcgcggactgctacgacgccctcaccacggaccgaatctataaaaaggccattgcgcccagccaggcgtttagcatgattctcaacggggagtgtggaaaattttctccccggcttttagagtgctttaaaaatgtgcgggacaggttcgcacggctctccgcggagtacgcggaccatctgcccggcaaggtaaagactgcgccccgggtgccggaaagcggctatgggggagagggagaaaatacgctggaacagagccagctcaaatattttgcccttctgcgccatctggatgccacggtgatggaggtagacctggacaccgaagtgtttcacctggtttatctgacggaccctgatttctccgcgctccggtccggcggcagttttgaggaggcgatccgcaattttgcccggaccgccgtacacccggaggaccgggagcggatgttggagctgctggacggatatatcgacgagctgtttgacgagggtatgaccaaccgggagcggacctaccgtgttctggagcgggagacggatacctatgtggtctgccgggcttccctgctgcgcatcaatctggagaacccgcgccagcatcgggtgctgttagtctggcagaaagaaaatccacggccgcatccgaagacggacggcgcgcagagcggcaaagcccggggccgtctggttgtggaccagctgctggggggcgtccagaagcgccgctgcgaccggtatttcaccatccttgaggtcaaccgcggcctggtaaatctgctcaactactcggaacaggagatttcggcgcggtttcataaccggctgatggagctggtttaccagccggaccgggagaagctggcccggcagttccgggaacagcgcagcgcaggcagggtgctggagctggaatatcgcctggtgggcagggacggccgcattgtgtgggtgtcggaccactgtgtggtagaggaggaaggcggcgcagaggtggcgtattgcgcgctgctggacatcacgcgttccagacgggcggaggaggagctgcgcctgtctctggagcggcacagcatcatcatggcgcagacaaacgacataatatttgagtgggatatgatccacgaccagctctatctctccgccaactgggaggcccagttcggttatccccccattaccatggatctacgcaacgaggtccccagggtttcccacatccacccggacgacatgcctgcgtttgtggcgctgatggatgccatgacggcaggcgttccctacaaggaggccgagttccgcattgtggatgcggtcggggtttaccgctggcggttggtgcgtgccaccgcccaattcgacatagaccacaagccctttaaggccgtgggggttattgtggatatcgattcccagaaaacggaacgggcgtatctggtggaccgggccgcccgggatgggcttaccggcctttacaacaaggggtccgcccagaaccgggtggaggcctatttagcctcctgtgatccggaggacctgtcggccctcatggtgctggatgtggatgatttcaagcagatcaacgaccggtatgggcacatgttcggggatgcggtactggtggagctatccgccaagatcgccaagcttttccgcagtcaggacaccgttgccaggattggcggcgatgaatttcttatttttatgcccaatatacataaggaggatgtggcccggcagcgggcagaggagataaccggcgcgcttcgggatatgctgagggacagcatgaagaatacggagttttcctgcagcgtgggcctggccttcgtccggggcggggacatccgcttcgaggatttgttcggacgcggcgaccgcgccctataccgggcaaaggcggagggaaaaaatcagcgcgtggactacagaagcgagatgcaggggcgtcccgccgaccttttcgccggggagacggcagggcggcgcacccggatcgattccgaccatgcgcagcagtggtccctctcatccctgatctccagaacctttgacatcctttacggcgcggaggatttttcggatgcagtgcagtccatcctggcgctgatcggggagatgtttgagatcagccggacctacatttttgagagcagcaaggacggccagcgaagcaacaatacctttgagtggtgcgccgagggaattgaaccccagatccatcggctgcagcaggtcccctatgtggacgagggccacgactaccgggataactttgagcgcgacgggctgttttactgccagaacactcagagaatccaggggtgggagcgtgggcttttggaaagccagtccgtccagtccacgctgcagtacgcgatccgtgaaaacggcgtgttctacggcatggtggggtttgacgattgcagaatccagcgcctgtggaccagagaacaggtggatgccctgatgtttgtgggcaagcttttatccgttttcctgctgaaacacagagcccaggaggccttgaatgaatccctgatcaatctgcacagcgtcctggaccagcaggaagcctggctctatgtgctggacccggacacctataccctgcgctatgtcaacatgagaaccagggatctggtgccggacgcggagccgggaaaaacctgttacgaggcattttacaagcgggaaagcccctgtgagaactgcgtgctgaaaaaggcccgggccaacgggcagagcaccatggaactatacaatcatattttaggactttgggtcctggccgacgcctccattgttcagtggaaccggcaggaggcctgccttgtgtgctgcagagatatctccccctacaaggagaagcctgccatggcacagaatgatgggaggaaataaaaaatgacagaacacgagcgcggggaccggccgcagaccggcgccgccggttttacgccggccgaatacgagtacaatacgctgatgcgtctgctgggggtcagcgtgagcaagcacctgctggatgagcatttcaccctgatttgggccaatgaattctattacgagctgatcggctggcccaaggacgagtacgaggcagagttccacaaccggccggacctctattaccagacggatcctgaggagtggcagaagctctcggagaccgtgctgcaggctctggcggccggtcaggagggttaccggctgctctcgcggatacggcggaaaaacggggactatgtctgggtgcagttctccgcccggtttgccgaggaatacatcgacggatatcaggtggcctattccacgctcaccaatgtggacgatctggtgaagatgcagagggaacagtccgtgacctatgagagcctgccgggctttgtggccaaataccggatcgacgccgacggcgaagagctgtatctggcgctgctttcggctaacagccgttttatggaatatttcggcgaggcagacaggaagaatgccgattccctctataaccggaacctccgggaaaacattgagatgcttaacgggcagagagaccggatactggccggggaacccctgcatttcaccatgcatgtggccagccgggacggccaggccctgtggcttcaggtcaacgccacctgcgtcgattggcaggagggaagcccggtttatctggtgattttcatcgatatcactgatgtgacggagcttcgggagatgcagcgcaaactgattgcccagacggaggcattaaaggatgctctcagcgtggcggagcaggccaaccgggcgaaatcggacttcctctcccgcatgtcccatgagatccgcacgcccatgaacgccatcatcggcatgacaaccatcgcggccgcctatatagaggaccgcaagcgggtggaggactgcctggaaaagatcggttactcgtccaagcacctgatgacgctgatcaacgacgtgctggatatgtcaaaaatcgacgcggggaaaatgcagatatcccatgaacccttcaatctggaaaccatcgtggagtccatcacctccatcatctatccccaggcggaggacaaggggctgatttttaacgtgcccctggtggatctgatcaatacggttctcatcggcgacgggctgcggctgaaccagattctgctcaatctgctgtccaacgctgttaaatttaccccaaagggcggcacggtccggctgagaatccggcagatgtggcgcagggccgggagggtgcgtctgagttttgcggtgagcgacacgggcatcggcatgagccaggattttctgagccatatattcgatccctttgagcaggagcgggtgaacgcggggcagacctacggcggaaccggtctggggatgcccatcaccaagaatctggccacgctgatgggcggaacgatttccgtcaagagcaagccggatcaggggaccactttcaccgtggaactggattttgacctgccggagcaggaaaatgaagtgccggagcagaagcaccaggctgtgcagtccttaaaggtgctggtggcggacgacgaccgggacagctgtattcactccacccttttgctgcaaaacctgggcatccagtccgactgggtacagaccggccgggagtgcgtggagaaggtggagcgggcttatcagtcgggggctggttacgacgtctgtctggtggactggcggatgccggatatggatggcatcgagactacgcggcgcatgagggagatcgtaggacaggacacgctgattattatcatcacggcctacgactggggcgccattgagaagaacgcccggtcggcgggagccaacgcgtttctggccaaaccgatttttgcctccaccctttacaatgccttactctctgtcacaggtatcgggaaggcggttctgcgcccgtccgccagcggcagctttcatcggccggagctcaacggccgtcacgttctgctggtggaggacaacgacatcaacctggaaatcgccatggagcttctgaaaatgtccgggatcacggtggattgcgccagggacggccaggaggcggtggacagatttctgaccaacgggggggactacgacttaatccttatggatgtccagatgccggtgatggacggataccaggccaccggggccatccgccgttccggccatcccagggcgctgtccgtgcccattatcgccatgaccgcagatgcctttcacgaggacgtggtgcgggcggcggatgccggcatggacggtcatctggccaagcccattgagccggagctgctgtatcagacgctggcggaaatgtttgcaggaaattgagggtgagggatatggagatcaacctgagctacgaccaactgaataatgagtacagcatgctgatgagcgttctgggagccagcgtcagcaggcatcttttggatgagcattttacgtgcatctgggccaacgattattattacgagctgatccgctatccgaagccggaatacgaagcacgcttccacaaccactgcgaccggtattttgccaacaaccctgagggttggaggcttttgagggataaggtgacctccactctggagaagggggagacaaggtacacggtatttctgcccctgatcgatccggacggagggaccttctgggtcaagctgcagtcggtgtttacggacgaatatatcggcgggtaccgggtggcctacaccgccatgaccgatgtgacggagatggttatggcccagcgggagcgggagtacacgcagaaggtctacaagaaaatgtcccgggagcaggagatgctcatgggcgcgctgaacgtcagcgtcagcaaacatctcatcgacgagcattttacctgcgtttgggccaacaagtattactataagctgatcggctacccgaggaagcggtacgaggcgctgtttcacaaccacgccgacgagtattaccggaataatcccgaggggtgggagctgctctcggccagggtggcgtcggttctggaaaacggggaagaccagtatgagatgatcgtccccatgaagtatgaggacgggtccagctactgggtgaaattgttcagctatttcacggacgaatatatagacgggtaccgcacttcctacacggtgatgacggatgtgacggagctaatgcagatgaaaaacgagcaggagctgttgatgcgggctatgaaggtcagcgtcagccgccatctggtggacgagcattttacggtgatatgggccaatgatttctattaccagttgatcggctactcgaaggaggagtatgaggccctgtttcacaaccactgcgacgagtatttccacaacaaccgggacagctggaattccatacacgacaggatcggccagatgttcgcgaagggaaagaagagctacgaggtgttcctgcctctcagaattccggacggctccacctcctgggtgaagatggtgggatttttcacggatacataccaggatggtaagcaggtggcctacactaccatggtcagcgtcacggatatgatccggatccagcaggagaagtccatcgcctacgacaatataccgggctttatcgtcaagtaccggattctgcctcacaccgtcgcgatgctggaagccagccagaggatcgacgatattttcgacttggacaggaaaaatctgggcagcattgacgcttactctattctgcagccggagagccgggcgcagatggaggccaaccatgaaaatttccgccggggactgccctatgagggcaccatacgcgtgaaagataaattcggccgggaccggtggtttcagatccactgtgcctgcatcgattccatcgccgatgatcccgtctacatgacggtgtttatcgacatcaccgatatcacggagctgcgggaattgcagagcaagctggaggagcgcacggaaatgctcaacgccgcgctggaggcagcaaagcaggcgagtatggcgaaatcggattttctctcccgtatgagccacgatatccgcactcccatgaacgtgattgccggtatgacggagattgcggaaagccacttgcaggacggggggagggtgaaggactgcctgaagaagatccgcctgtccagccgccatctgctgggcctgatcaacgacgtgctggacatgtcccagattgagaacgggaatttccacatcagcgaggagccgatctccctgccggaggtgctgcgggacgtgaacatgatcacgctggccggaatccgggagcgcgggcagatttttgacgtccatgtggtcaatttggggcaggaacagtttctgggcgacgatctccggctgcgtcagattttgctgaacctactgtccaacgccgtaaaattcacgccggcgggcgggcagatcgttttcaggacggaacagctgcccgggacgcaggggggaaggccgctcatccgctttgtcgtctcagatacaggcgtgggcatgagccgggagtttatggagcacatatttgaggcgtttacccgggagcaggacagccggaccgaccgcatcgagggcagcggactgggcatgtgtatcacaaaacgcctggtggacatgctgggcgggaccgtcacggtgagcagccggccgggcgtaggcacgacctttgaggtaacgctgcccatggagccggcgccgatccgggagcggccctccctgccggacatgggcgttctgctggtggaccgggatccggtggtgctggagcagggctgccggctgcttgaggctctgggagttgaggccgggggaacagacaatgtggagtccgcggccgccatgatccgggaccgcagacagatgggacgggagtatgcgctggtgatattggatgcagatatggccggggagtccggggaggaggccggatttattttggaggagctgcggggagctggtcggctggcgctgtcttccctggagccgggcgggaacagatcgggcctggcggccatggctgccggatttgtggaaaagccgtttttccgctcgaccctcagaaactgcattctggagtatgtgcagggggaaacgcagtcggagcagcaggcggagtgccacgatttcagcgggaaacggtttctgctggcagaggacaatgaactgaaccgggagatcgccctggagctgctgggggccttgggcgccgggctggagactgcggtaaacggccgggaggcgttggaacggttccggcagagtccgcccttttactatgatctgattctgatggatatccagatgccggtgatgaacggatatgaggcagcccgcgcgatccgggcgctaaaacggcgggatgcggaaagcgtgcccattatcgccatgacggcggacgcttttgtgaaggatatccagagcgccagggaggccggcatgaacgggcacatggcaaagcccctggactatgacagtctgtcccgggagatcagccggtatctgggggaggtatgaggaaggcgctgcgggtgagcaaaaaagctcacccgcagcgtttggcctgaatggaaggggccgctggcgcagcctgcggctcattgcttttgggcttgccttttcatccagggtttgttatactggatcatattatttctggtccgccgttctggcgggcggtttcagccggttccatcgtcgtgttcgagaaatcttttaaaacccccgggaaatgagataaaacagggccagagcagggagagagacgggaaggagtttgtgtttacgcatggataagtatgaggtactaaaacaatattttggctatgacgcgttccgccagggtcaggagatgctcatcgacagcattctggcggggagggatacgttaggggtcatgcccacgggcgcgggcaagtcgatctgctaccaggtgccggccctgatgatggacggaatcactctggttatatcgcccctcatctctctgatgaaggaccaggtgggcgcgctgaaccaggcgggtatccacgccgcttacttgaacagctccctgagctccgcccagtattttaaagcgctggaattcgcgcgggcgggacgttatcccattatctacgtggctccggagcgcctttccacggacgcattcctggattttgccctccacgccaagatcgccatggtggcggtggacgaggctcactgcgtgtcccagtggggccaggatttccggccaagctacttaaagattgtggaattcatcgaacggctgccggtgcggccggtggtcagcgcctttacggctacggctacaaaagaggtgcgggacgatatcatcgatatcctgatgctgcgggacccggcggtggcgtccacgggctttgaccggcccaacctgtatttcggggtgatgtcgcctaaggacaagtacgctacgctgctgaattacctggagcggcacaggggggagagcggcattatttactgtctgacccgcaagaacgtggaggaggtgtgcatgcgcctgattaaggagggttttcccgccacccgctaccacgcgggcctcagtgacgccgagcgccggaccaaccaggacgattttatctacgaccgcagcccggtgatggtggccaccaacgccttcggaatgggcatcgacaagtccaacgtgcggttcgtggtgcattacaacatgccgaagaacatggagagctattaccaggaggcgggccgcgccgggcgggacggggagccggcggagtgtattctgctctacggcggccaggacgtggtgaccaaccagacctttatcgagtacaaccaggacaaccaggagctggacccggtgaccaagcagatcgtcatggagcgggaccgggagcgtttgaagaaaatgaccttttactgcttcacaaacgagtgcctgcgggactacattctgcggtattttggggagtacggcgggaattactgcggcaactgcggaaactgcctgagccagtttgaggaggtggacgtgacggagatcgccagggggctgatcggctgcgtggagagcagccgccagcgctacggcgtgaatgtgatcatggacacggtgcacggggccaacacggccaagatccgcaattaccgcatggacgggaatccgtactacggggagctggccaaggtgcccgcctacaagctgcgccaggtggtcaattacctgctgttaaacggctatctctcctccaccaacgacgagtacgccatcgtgaaattgacggagaaatccggggaggtgctgcgcggggaggaacaggttctcatgaagatggccagggagcaggaccacccggccaaggtgaaaaaggagaagaagggccgcagaggcccggtggccggagcggagttcacccaggccgaggagaccttgttcgagaagctgcgggctctgcgggccgagatcgcccgggaggagaaggttccgccctatatcgtattctcggacaagacgctgacccatatgtgtattctaaagcccgggacgaaggcggagatgctggaggtgtccggcgtgggcgcctttaagtacgacaagtatggggagcgttttttggagtgcgtgaaggttgagaaggaaagcatgggggagcggaaggagacgggagcggccatggacgcggacagggggtttgcggcggagttaagcggcggaactgagaggcggacggctgaggcccggcatggggaggagcgtaaggatagaggacgggaggaaagcgtctggcgggccggggccggccggagcttcgattcagctgacggcctggggtatgaggacggcggtctgcctgacgaatcctattatgagccggacgacctttacttttccagcgacagcgacgaatacggcgactggaccatagacgacgccatgtcggcctgggagagcgcggccacggagccgcccagccccgggcaagcgggcactgtgcggcgcgaggagccgcccgcctccccctccccggctaagaagaaaaagagcaaaaccgccaaggtagagttcgccatgacccgggagttggcggagcagatccatttttcggagcaggccaccttaagcgactttgtggggcagatcaacgacctgcgcgacgaggacgccatgaagcggctgaccatcaaatccgtggaggagaagctgaacgcggacggttattttgaagaacagtttatcggtggaatgaagcgcaaaaagctgaccggggctggggaatccttcggcatcgtggcggagaagcagctgagcgagaagggaaacgagtacgacgtgttttattacacggaaaaggcccagcgggggattgtggagtggctactggaggtgtgagagatatgatatccaaaaagggaaagcgcaggatggaatacaatggcgcggtttattattggtttgtgaggaaaaaccgtgagggcgttccaagaatccacatcctgtcggaagataaaaaggtcaatctggaattccctctgtttgactctgaggtttccaccacccggcaggagattgaacggcttttaaagcagcagatccatcccgatgatcccggtgggctggctccctaaagggctgtccgccccgcgccgcaataccgctgtacaaacttcatgaattgcaggacatagggctttcatatccggcgcttgccatagacaatataaaagatgtgcttgtgggcagattttccagtgggaacaggagaatctgccttgtcttttccggatcctttatcggacaggcggagacaatggagaaccccagaacggaggcggattattccaccgcggactgagggcagattgagacgagggtggcggcgtttattgagaggttgtagcggatcggggggaaatggacggggccggattgtgaatccttcatgatccggcccgatttttgtggagaaggagggcggttcgtggtagaatacagacaaaaccggattttattggggaggcccgcagagcggcggtagatgggaggaaatggagatgtacggcagaatattgaccggagggggacgtttctacaccttccttgggccgctgtttcaggcggttgggcagcggcagaagcagtataattggctgattacggattttgagggtggatttcctctggaggagcatgtccggctgaaccgccggaacctgcgggagcggtacgcctggatcgacggcgggacgcttacggggctggccgggcaggaggatgcgcagtggagctggggcgttttttccggttttgaccggtcggtgacgctggaagaagcgctggaatatgacccgccctgggcggacggcaatccgggattctgggaaaatcccgtctcaattcagcatccgctggcccaaatggagatcgtggcctgggataatgcctgcaccattttgatcagccgggatcaggaggcggtgcgtggatttgcggcggcgtttccggacagcatggatttggagcgatataacgaggcggaggctgcgccggaccagtcggcggcttatgaggcgtggtttcgcagaaatggggagcggtagcgggtggagccaggcggcgtccgggaaaacgcttgactcttacgcaacgtcatagcttatagtggagtcatcaaaaaacgggaggcgattttaatgaaaacagtaaaggaagtctcagagctgaccggcgtcagcccgcgcgcgctccactggtatgaccggatcgggctgttaaagcccacggcgcacagcgaggcgggataccggctctacgatgacggggctctggaaaaactgcggcagattctgtattttcgggagttcggcatgccccttggcgagatccgggcggttttagagagtccggaatatgaccggaaggcggcgctgcgtcagcagaagcgccttttggagctcaagaaaatgcgcttggaacgcctgataaccagcattgacgtgattctcgccggggacgacaagctggatttcacagtattcgatcagtcggagatcgagggcattttacagaatatgatatcggagctggatgaacagcagcgcgacaggctgacaaatcggtacggaagcctggaagcgttccgggaaatggggatcaggaactttgagaagccggagaaccgccggtttttgcagaagctggtggagtggtacggcagcaaggagcgggcgctggcgcggatgtacgaggcgccggacccgagggtcatgatggagaacgcccagcggattttgaatatgtacgaaaaactcaaccgcctgcgcctgcaaaattgtcccgccggcggagggccggcgcagcaggccatgaaagagttggaggcagtgctgttagacacctccgggatggaacaggtgaagccgcttctgctggaggaggcggacggcctgcttgcgggcggcgaggcggtgcggaagatggatgagaagtacggacagggctggagcgaattttacgtgcaggcggtgatggcgtattgtgaatgataaatctggaggaattctccactatgatttcccggaatcccgtccaaagcctgtgttcttcccgatatttgggataaaatggaatgtaaaggcggaatttactcgtggaaattccgctgtcgtgtcatgagatggaggcggatatgcagcaggacgtactgaaacttttttcacccgcaacggcggagtggtttacaaatacattcggagagccaacggatgtgcagaaagcggcctggcccgccattgcggccgggaaaccagccctggtcagcgcgccgacgggaaccggaaagactctgtccgcattcttgatttttatcgaccggttaaactccctggccagggagagggagcttaaggaggagctgtatctgatctatatttcccccctcaaatccctggccggggatatccgggagaacctgcggcggccgctccttggtatcccgcgggaggaggggcaggaggagatccaggtgggaatccgcaccggggacacgccccagaaggaccggcagaggatgatcaagcatccgccccacatcctgatcaccaccccggagtccctgtttctcatgctgacatccaaaaatggacggtctgtgctgaaaacggcccgggcgctgatcatcgacgagctccatgccctcatcgacaccaaacggggagcgcacctgatgctctccgtggccagactggaccggctctgcggcagaaatttacagcgcatcggcctgtccgccaccattgaacccctggagctggcggccgcgtacctgtcccctgagccggtgcagatttgcgccccagccatgaaaaaacaggtcaggattcaggtcatcggcaccgcgcccgcggtggggcggagaaaggacccggtctgggaagaactgggaatggcggtgtaccggcaatgtctggaatgccggagcgtgattgcattttccgagggacgccgctatgcggaaaagctggcgtactatgtaaatctgctgggaggggacggcttcgcccgggtccaccacggcagcctttccaaggagcagcgggcagtggcggagcaggacctgcgggaagggcggctccgcctgctgtgcgccacctcatccatggagcttggcatcgacgtgggcgacgtggagcgggtgctgcaggtgggctgccccagaaccatttccagcaccatgcagcggctgggccgggccggacacaacccggggcgggtcagcgaaatgctcatgtatccgcgtaccgcctcagagaccgtatattgcggcatgaccgcccaggtggccagactggggggcgtggaacaggcccggccgcccaggatgtgcctggatgtgctggcccagcacctggtatccatggccgcaggggagggatacagcgtggaggatgtgctggaaatccttaagcgggcttactccttcagggacgtgaccggggaggacgtgcggcagacgctggaaatgctggccggggactatgagcacgaccgggaaatccccgtgcggccccgggtgctgtacgaccggattcacggtctggtggccggggacaactacagccgcatgctggccacggcggcgggcggcactataccggacaagggcctttacgtggccaaaaccgaggacggggttactctgggggaactggacgaggaattcgtctacgagtcccagatcggggataagttcatgctgggctccttcggctggcggattgtgcgtcaggacaaggactcggtgatcgtcacccaggccccggcggagggggccagactgcccttctggaagggggagaccaagggacgctccctgcggaccagcctggcctttggaaaaattttgcgggaactggagcgggctttgtcggaggggaagctgccggaacagttgggggccctggggctggacgaggccgccgcagagcatgcagccgggtttatcaggcggcagattcaggccacgggcggcctgccggacgacaggaccattatcgtggagcattttagggacagcacgggcagccaccaggtgatggtccacgcactgttcgggcggcgggtcaacgcgcccctgtcgcttctggtacagcgggccgccgtaaccatgacagggatggaggcgggctgtgtggacgaggaagaaggctttcttctgtacccctacggaaaggaacagctgcccgagggcttgctgtatcagatcgacccggagcgcgtgcgccaggtattggaggcgcttctgccggaaacgcctctgtttgccatgagcttccgctacaacgcggcccgggccctgatgatggggatgcgccatgcgggccgtcagcccctgtggatgcagcgtctgcggagcgcggagatgctcagctccctgatcgaaacgccggaccatcccctgatccgggagacgaagcgggaatgcctggaggaccagtgggacatcgacagcgtcattcagatattgaacgacatccgcgccggtttgatcgccgtgcgcgaaatccatgtggatattccctcgcccatgtccctgcccttccagtggcaggtggagacggcggaaatgtatgagtattcccccaccacctccaaaatacgccgcgccgtcagcgaggagctgaagcgggcggagctggtgaagccgcctgccgaggaattatccaaaaaatgggagcgcaggaagctgccggagaatgaggagcagctccacgcccttctgatgatggaaggagatctggccgccggggagctggaggtgcccgccgaatggctggacaacctggcgagacgcggcctggcctgctacctggaaccgggaatctgggtggcggcggagcagcgggaggcctatgagatggctttgggggcagggaggaatgcgggggagatggagtcgccgggaaggggcggaggagacgcggcggaggggagcggggagacgttggactcggttgggatgagcggaggagacgcggcggaggaatgcgggcaggtgcagatttccccggaggagcaggctgttcggcatattgtgcggcggctgctctactaccggggcggacagaccgcgggggcggttcaggagcggtatttcctggccgacggggtttccgagcggattttgtacgcgctctgcgcctccggggacgtggtggaggacgggggagtttactatcacggaaaactttatgagcgggcccgggagggatacatccgcagcctgcgcacccagaccgcgacccagccgccggagcatttcgccgccctggcggccctcagagcagttgcggccgggccgcccgaggagcagctgaagcagaccgtggccctgtactgtggacggatgtttcctgtaaaatactgggaaaatatcctgcttcccagacggatcaggcgctacagcggggccatgctggacaaactgctggcggagggggattatttctggcggatgacgccggagggaaatctctgcttttgccggtatgaggacattgactgggacgcgccgctgccaaagggggcggagagcctggagggcgatgaatttctcatgtaccgggaactggcgcgccggggagccagtttcttgaaatttctcaccggagtgccgaaggaggacagcgcccaggaagtgctgctgcgtttggcggagaaagggctggtctgcgcggacagcttcgtgccggtgcgccagtggcagaaccgggaaaaagtgaaaaaggccacggccagacagcgggtaaacgcccgggtcatggccctgtccgccggtcgctgggacgtggttcggccggtgaagcaatggagcgaggaagcgtggctcgaagcatttttcacggaaaacggactgctgtgccgggagacgttccgaaagtccctggccgaggtcagcggctcgccgtatctggcgggcggcgctgagcgcgggggcagtggagagagtggagcggggcaggaaaatcaaacgccggagcccttcagctggaaacgcgccctggaactgctgcgaatctgggagtacaccgggcggatccgccggggatattttgtggccggtttgtcgggcgcccagttcatccgccgggaagagtacgacggcataaccgccgccctgaaggacccggcaaaacaaatcctgtggctgaacggcaccgacccggcagttcagtggggcaaggccctggaaatacctgcggagcagggattcctggcggttcccggaaccgctgtggcgctgaacacaggccgcctggccgcggtaatggagcgccagggaaaaatcctgcgggtgtacgagccggactgcctggaagaagttctgactgaatttgtgcgggattaccggcagaactcgctgttcgcggaacagaggcggatcacggtgaaggagtatccatgcgaagccggggaagcgctgcgaagggcgggattcatgcaggagatgggggatcttgtgctgtatcggtaaatatggaaggtaatgttgccggcctgggagcttttgtgctccgggccgttgcttttttgtgaggggggatggggaggcggcgggaaagcagttttcaaacacaccctagccggtaggagggctgtgtgataaaatgagggaaacgggaaaatgccgttggggaatttggaaatagggcctgaggcattttacgtgatcgttaggagcgcaagaaggcaggaggggatgggaatatggggacagaaaaattaaaggaagcgcagcgggaagaaaaagcggtgggtgaagagctgaccggaggaaaattacgggaatcctattcctatcatgtgcgatatgcagacgcgggtcacgactgtcaggcggaaatttgcgttacaaaatcccaccgatatggttacgaccttcgtctgacgctgggcggttacatctttgtggggtccaacctctgcgattttgagctggaggacccttcccaggcggaggctgcggcccgggagttctgcctgatgaaatggggcggctatgccgcatatggagacaggattatgccgtacgcctacgccttgcagagatacagcatggaggttgagattccggtggaggcagagcggcgggaaaatggggagcgggttgcaggcattatccgcatcgcctaccggatggaggcctgtgattcttctagggcgcacagcaggtgctactgtgacgacagggaaatttacctggacgatacggtatgcacggagttcagtttgacggtggacggacatatttataaagcggaccgccccaccacgtattttgagcaggcattgttgcagatttgcaagaaatgcggccgggaatacctgctccgctgctgcttcacctgccagtattccgactattcgccttacgggtgcgacgatttcggcagcatgctgtgttatagagagcacaaggaggtttacctgaccgtgaacgataaggccggatattttgaccggttggaaggactggattgtgaaatcgagcaggagacgagtgtgtgcggggagtttgaggagcgggcgcggtgcgaagggtatcgggggatggtggatgggattgggggagttggaacgtgagggaagtaccattttttaggtctataacttggttataatttccataaaaatattgaaaatacctttgaatatgttacaatatgttgtatagaggggaggggtgagcgaatgtacaaagcccacatcagcgaagataaaacccgttcccagtcagtcgcccaacatctccagggcacacaaaaactggcaggtgaattcgccgcggcatttgattgcagggaatggggggacggctgtgggctccttcatgacattggcaaatacagcgccagttttaaacggagaatcgatgaagggggaccgatcacggaccatgccacagccggagcaaaggaactatataaccggggaaatgtttttggcgcatattgtatttcaggtcatcactccggtttgttggacgggggtaccgtcggagattccgccggggaagcgactctcatgggaagaatgaaaaagcgtttggacgattacagcgcatttcagcacgaagtggagattccagcgttccccgctccgcttttaaaacctctgggaaagggaggatttagcgccgcattttttgtgcgcatgctgttttccagccttgtggatgccgactacctgaatacggaagaatttatgaaggaaggcaaaaccggcagagaacccgccgagtctatggacattttgctgcagcgcctgaagcaatatgtagctgcctggttggaaaataccgatttgacaacaatcaatggcaggcgttcccggatactgcaagcgtgttttgacaagggacaggcagctcagggcttgtatcagctgacagtacccaccggcggcggaaaaaccatatcttcccttgcatttgcacttcaacatgcgatcagacatcatttgcagcacatcatttatgtgattccctacacgaatatcatcgagcagacttcacaaatttttagagatattttaggagacataaacgtattggaggaccattgcaatgtctcatatgacagtccagaagaattaaagataaaacagcttgctgctgaaaattgggattgcccggtggttgtcaccacaaatgtccagttttttgagtcgctgttttccaatcggacgtcaaaatgcaggaagctgcacaatattgcaaaaagtgttatcattttcgacgaggctcagatgctgccggccagctatctgaaaccatgtacgcgtgtgattaccgaactggttaccaattaccattgcacggcagtcctctgtaccgcgacacagccatcacttgaagcattttttccccagcagctccgtccggttgaaatatgcccggatatacaagggcagtatgcatttttcaaacggactgcgtttcagatgatcggagaattgacagaagaagcgctggtagaacggttgaacacacatgggcagattctgtgtattctcaacagccgcaaacgcgtacaaagcgtttataaagccttaaaaggggacggaacgtaccatctttcaacgtttatgtatcccattcaccgaaaaaatctgttaaagaaaataaaaacttgtctggaaaatggtcagaactgccgtgtgatcgcaaccagtctggtggaggcgggggtggatcttgacttcaaaatggtgtatcgggaattagctggcatcgattctgtgattcaggcaggagggcggtgtaacagagaaggtaaagaaaagccggaaggaagccggaccgttgtgtttacgctggaggaatcggaggatattcatatacctggccagttgaagcttccgattacggtggccgggcagattgctagaaaatttgaagatatatcctcattagaggccattcacgaatattttgagcgcctgtaccatttccggggaaacgggctggatgccaaaaatattgtcgatcagttcgagcaggcctcacgctcactgctgtttccgtttgccacagtggcggagcaatttcacctgattgaaaatgagaccaaagcaattttgatcgataaggaaatgagagcgcaggagattgtggaaagtctgcgaaatggagcgcattcactgcagttactgcgggaagccggtcaatattgcgtaaatgtgtatcagaatgattttgaaaatctgaacggggccggtttactggaagcattggacgaacagatctatgttttgcgagacagaaaattatattcagacgaaatggggcttcttgtcaatgtcagccgtggagaagccgtatttgcctgaagtggatgagaaaggaggagacagatgggctggggagtgagagttcacgtgtggggcgattacgcgctttttgcccgcccggagatgaaggtggagcgctgcagctacgatgtgatgccgccatccgctgcgcgtggcatcctggaggcaatttattggcatccgggaatgcggtgggtgatcgacagaattcaggtgagaaaaccgattcagtttacgagtatccgaagaaatgaggtcaaaagtaaagttttggttggaaatgtgttgagggcggtaaatggaagttcaaagccactgtatattgctagcaaggaagagattgtgcagcgggcagcaattctattaaaagatgtggattacctgatcgaggcacattttgaaatgacagaacgggccagcgccggcgataatccgggaaaattcaaagatattgttatgaggcgtcttcgccggggagaatgcttccatatgccatatttcggctgccgggaatttccagctaactttgaactttacgaggcggatgatctgcaggatggagacggcagggaacaagatttgggatatatgctatacgattttgattattccgatccagaggacatcaagccgatgtttttccgtgcggtgctgagaaatggcatattggatgtgagggactgcgaggtggtgagatgattctacagtcgttggtgcattattatgaagcgctggaacgtgcagaccgaataacacgtccgggatggtgcaacgccaaggtgtcatttgggctggaattgtcggggaatggcgagctgctggcaattattccgttgaaacagccggtacagcggggaaaaaagacggtcatgctgcccgtcgacatgaaggtgccgcagttcttatcacggtcgtcaggggtatccgccaactttttgtgtgataattcaagctatctgttgggcattgacaacaaaggaaaaacggagcgttccagagaatgctttctggctgcgaaagagaagcatttgaaaattttagaaaacgtaaacagcctggctgccgtcgctgtaaaatacttctttcagcagtggtctcctgatcaggcagcagaaagcccggttctgatcccatatctggaggaaattatggcgggcgccaacctggtgtttttccatgacagggatttcgcgcaggaagatccggatatacaggaggcatgggagagtttcagcgccggaaatggccggaaagccgatggggtttgcctggtcacaggacagaaagcggagattgcgcgtatccacggcatgataaaggggcttcccggagcgcaatcaagcggtgcagcccttgtatcattcaatgcgtctgcctttgagtcccatggaaaatcccagagcttcaacgcgccggttggaatatatgcgacatatgcttatacgacggctttaaactacctgttggctaataaacagcacacttcaagtatcggggataccacaatcgtatactggtcggaagaagcggaagaggtttaccaaaatatattcagtatggcggcggaccccacgattgacaaccaggaaattctggatggggtctttaagaatctggagtccgggaaggcggttgcggtaggagatgtagagacgaaaatctctctggaccagcccttttacattttggggttgacgccaaacgcggcacgaatcgcagtccggttcttttatcggaataccttcggcggcattctcaaaaatttgaaacgccattatgacgagatggaaattgtccgcccgtcaaatgattcgatcgagtatctgggcttgtggcggatgctgcaggagacagtgaataaaaagtccagggataagaatcctgtttcaaatatggcgggcgctgtgtaccgggcgattatttccggcagccggtatccgaattcgctgtatcaggaggtgatcggaagaatacgggcggatcaggataatcctgataaccgtatatacaagataaccaggggaagggcggcaattattaaagcctatcttatgcgaaacggaacaatcaaaaaggaggagataacggtgggattaaatgagaactgcagcaatccggcgtatgttcttggccgggaatttgccgtattggaggcgattcaggaagaggcaaatccgggtatcaacgccacgataaaggaccggtatttcaatgcggcatgcgccactccggccataatctttccggtgctgtttaagctgaaaaatagtcatatccgaaaattaaatagtcgtaataaagtgatttactacgaaacattgcttgaagatttacagggaaagctgctattgaaggatgatcaaaaaactgcctgtccgaggcgcttgacattggaagaacaggggatgtttattctcggttactatcatcaaacccagaaacgatatgaaaaaaaggaggataagtgagatggctgaagtgattaaaaaccggtatgagtttgtggtgctatttgacgtagagaacggaaatcccaatggtgacccggacgccgggaatcttccgaggattgatcccgaaagcggctatggactggtcacagacgtatgtctgaaacggaaaatccgcaattatgtggagaccgtaaaagaggacgaacccggctttaaaatttatatcaaagaagacgtgccgctgaaccgcagcgataacatggcgtacgaatatctggaaaccaacgacaaggacgtcaaggagttgaaaaagaaagactcggatgtggatcggaaaatccgtgactttatgtgccggaatttttatgatatccgtacatttggcgctgtgatgaccacatttgtaaaggcggcattgaactgcggacaagtcaggggacctgttcagttggggtttgccaggagtattgatcccattataagccaggaggtcaccattacccgcgttgcaattacaacggaaaaagatgctgaaaacaagaaaacggagatgggcagaaagaatatcgtgccttatgcactataccgtgcagagggctacatatcagccaatctcgctcgaaaggtgacaggattctcggaggaagatctggaactgttatgggaagccattatcaatatgttcgagatcgaccattcggcggcccgcgggaaaatggcggtgcgcgaattgattgtatttaagcacagcaaagaactgggggattgcccggcgtacaagctgttcgaggcagttgaagtgaaaaagcacgacgacgtcctatatccaagaaaatacagcgactactgtgtcgaagtccacgaagagaagatccctgatacggtggaggtgtcgagaaaaatataatggaatacagggaagatgattatttgatgctttccggtatacaacattttgcattttgcagaaggcagtgggccctgattcacatcgagcagcagtggcaggaaaatgaacggacggttgcaggggatctgcttcataatcgggcccacgattctttttttatggagaaacgcaatgatgtggtaatcagcaggggactcccggtgcattcccggaaaatgggcgtgagcggcgtctgtgatatcgttgagttccgggaggatcaaaatggcatttcgctctacgggcacaggggatcgtatatcccatatccggttgaatacaaaaaaggaaagcctaaagctacggagattgatattttacaattaaccgctcaggcgatgtgtctggaggagatgctgtcggtgaaaattgaggagggtgctctttactacgctgaaacacggcacagagagatagtggaatttaccgctcagcttcggaatcaggtacaaaaagcgttccaggaaatgcatcagatgtatgatagaaggtatacgcccaaggtaaaatggtcaaaaagctgcaatgcctgttcattgaaggatatctgtgtccccaaactgggaaaagccgtgtctgtcaggtcctatatccaaaatgctatttcgggggatgaagaatgaaaaaattactgaatacgttgtatgttacaacacccgagagctatctttctttggacggagaaaatgtggtgatttttaatgaagggcaggagatggggcgggtcccgcttcataatctggaggcaatcgtctcatttggttacagaggcgtcagcccagccctcatgggtggttgtgcccagcggaatatctcattatgtttcttgacgccacaaggcaaatatctggcccgcatctcaggtgcggcgagaggaaatgtactgctcagaaaaaagcagtatcaaatttcggaaaaaccggaagtctgtctggaaatttccaaaaattttatattgggaaaggtatataatagccggaaggttttggaacgagccgttcgtgaccattctctgcaagtggatatagataaaatagggcaggcatcggaattcctgaaatgttccctgcaaaatatagagcagtgcaaagacatggatcagctcagaggatacgagggtgaggctgccagcgtttactttggggtgttcgaccagttgattttgcagcagaaaaaggattttgtatttgaaactagaacaaggcgccctccattaaacaacgtaaacgccatgctttcatttatttatacacttttgggaaatatgattgcagccgctcttgagactgtaggattggatccatatgtgggatttatgcatacggaccgtccgggaaggcaatccttagcccaggatctgctggaagaattacggcctgtactggcggaccgttttgtcctgacgctgattaaccggaagatggttacaaaaaaggactttacaaagaaagaggacggagcgattctgatgggcgatcaatccataaagctgcttttgaccgagtggcaaaacaagaaaaaggagattataacccatccgtttttacaagaaaaagtagagtggggaatgataccatttgtgcaggcgatgctgttgtcaagatatttgcgcggtgatattgatgaatatccgccattttttttgaagtaggtgaggctatgatggtgctggtaacatatgatgtcaatacagagacgcccgctggaaaaagccggctgcgtaaggttgccaaagaatgcgtgaactacgggactcgggtacaaaactctgtatttgaatgtgttcttgacaatgctcagtttctattgctgaagtcgaaactgtgtagtatgattgatgaagaggttgacagcctgcgcttttatcatttgggaaacagccataaagcaaaagtggagcatgtgggactttgcaaagggattaatgtggaagagccattgcttttttgagagtatttgatggatgtttttcaggggagccagcttaaatgaatgggacgaagaggggatttcaagagaaatgtaaataaatggtgagtatttcaggggatattgggcgtggctgggtcgaagcgattgaggagatgagtatgtatcgcttaaagtcgtaccggattgagtggatattcctttagggcggctataggaatcagccgatcaatacgttcaggtgcgaaacccaagtgaacataaatcccccagcagattcgcaccaagataatagacgagtgtcgataaaatggaaggttatttaataaaggacttgggggaatgtagtgaaataaaatgatatttgtgtaaatgtgctgaaatgatatgctttttattgagcatttttgctgtcgaggtctgcgaaggcctcgtggattgaaatccattcctgccacttctgacggcccggttttttcggtcgaggtctgcgaaggcctcgtggattgaaatgccacagtgccacctcctgctaactgtagatagccgtcgaggtctgcgaaggcctcgtggattgaaatataactggtttattggctgctgcggctgctgcggcgtcgaggtctgcgaaggcctcgtggattgaaataatgacaccaggcacaagcatatcatcctgaccgtcgaggtctgcgaaggcctcgtggattgaaataaaatagtctgtgtgcagcttctgggcgttcatcgtcgaggtctgcgaaggcctcgtggattgaaataaaggaccacggagagtccattgctgatttgatgggtcgaggtctgcgaaggcctcgtggattgaaatctcacggttccgatgtcacctaggcaagtaatggtcgaggtctgcgaaggcctcgtggattgaaattgcttcagcagctccgtgttggacgggtccaactgtcgaggtctgcgaaggcctcgtggattgaaatcgtatttctgagcaccttcaggaactcaaacggctgtcgaggtctgcgaaggcctcgtggattgaaattgattactgccgatcttttgctggcgttgcttttgtcgaggtctgcgaaggcctcgtggattgaaattctaatgaattgttgacaacctcgtgcctccaaggtcgaggtctgcgaaggcctcgtggattgaaatctgaagaagcggacggacatttttgagagccgggtcgaggtctgcgaaggcctcgtggattgaaattattaagtctgtcattttgttttcctccgttcctttgtcgaggtctgcgaaggcctcgtggattgaaattttcagcttttgcgccactgttcttccgtcctcggtcgaggtctgcgaaggcctcgtggattgaaatccggtattcagcagcgtcgccacaagtcgtattccgtcgaggtctgcgaaggcctcgtggattgaaattcgggttaaaattgatggtacatacgaaacattttgggtcgaggtctgcgaaggcctcgtggattgaaatagccgacgagagaatggcggccttcaggcgggcgtcgaggtctgcgaaggcctcgtggattgaaatcactgatcacggcgtaattatccccgctcttcaagtcgaggtctgcgaaggcctcgtggactgaaatatgtaccagggaccggggaaggccggtaagatcgcgtcgaggtctgcgaaggcctcgtggattgaaatgctattgccaagacatatgcgagcattgcagcaatgtcgaggtctgcgaaggcctcgtggattgaaattaaacccattgttttttgcactatctgtatatggtcgaggtctgcgaaggcctcgtggattgaaattgatcaatgtaggtgtctgatgtgtaatccgcaggtcgaggtctgcgaaggcctcgtggattgaaataatcgattatagacggcgattatatcccgtttgggtcgaggtctgcgaaggcctcgtggattgaaatacctttcctattccccggaaaacctgcctgacacgtcgaggtctgcgaaggcctcgtggattgaaatataaactgaccgtaatcccactgtgtcagcccttgtcgaggtctgcgaaggcctcgtggattgaaatcctgagctgcacaggtctggacccacttggcgggtcgaggtctgcgaaggcctcgtggattgaaattccatcccgcgaaatgcaggcagttggaaatgatgtcgaggtctgcgaaggcctcgtggattgaaatgtttattatagcaactttgccatttaggtcaccgtcgaggtctgcgaaggcctcgtggattgaaatacatgtaccggctggtttgccatattatcaccatcgtcgaggtctgcgaaggcctcgtggattgaaatcactggcacggagcggatgccggatccggcggagctcgtcgaggtctgcgaaggcctcgtggattgaaattttacaaaccgggactgccggtcatatttctccgtcgaggtctgcgaaggcctcgtggattgaaatctggcggtcgccggtgatggtgaagagattgccgtcgaggtctgcgaaggcctcgtggattgaaatccagtcactcttaccattagctcgtagatctttgtcgaggtctgcgaaggcctcgtggattgaaatatagtaacatgcacatttgtgcttgtcctgtattgtcgaggtctgcgaaggcctcgtggattgaaatagaaaatccttctttaaaagccatcagcatagggtcgaggtctgcgaaggcctcatggattgaaatataggcacgtccataaatggataagttcagctcagtcgaggtctacaaaggcctttttgattgatatatttaggcgctattttaccatccgctgtcgttttcgtcggggctgcgaaaaactctcggattggaactattatgtaaaatatatcaatgcactctagcttgtaaatctccttgcatcctcaacttttacatactataataaaacagcgtaaaacgaaaatgacaaagataaaaacacaaactggtcggtagtccagttgcggcttctcatctttcaatctctcctctcaagccgtcagtaaccttcctccttaggtcgtccattctttgcccattcaaacttttaaggaggacaagaaatggacaaggcagcggtaacactacaagtatttttcgaagattctttttgggtaggaatttttgagcgggtgagtgccgggaagttagaggcatgtaaagtgacgttcggtccggaacccaaggactacgaggttttggacttcatccggaaaggttacttcgggctgcggtttagtccggctgtggaagcaactgtaaagagccgtccggcaagccccaagcgaatgcagcgggaagccaggcgccaggttcagaatgtgggaattggaacaaaatcccaacaggcactgggcttgcagcatgagcagatgaaaatagagcgcaaggtgttgagccggcaaaaaagagaggaagagaagcagcgcctgtttgagctgaagcagcaaaaacgtaaggaaaagcaccggggcagataattcaatcgctgtccccccgttcatctgcttttcaaaaacaaaaaagtcctgcggacaggaagcattttccgtccacaggacttttatttttgaaaataatgggtcactggcgcagcctgcgggctgttgtgatctgcccatcacgcagttacccgatcgcgcccaataaaaaacgcgccattttcaggtacgagatatttactactataacacaacacaaattataagtctattcagttttaactttcctggtaaaataaaattaacggcgccgtaaaccaatttgagaggagcaaccaagatgtcagctaattttcagaacatagcggattattatgacgcaatgtatgtagagccaaaagaatatgaagaagagaccgaaaaagtaatacaactgattgaacaatatagccaatcggataatacccgtatattggatattgcctgtggcacaggggaacagagcctatatctggcaaaacattatcaggttacggggattgatctgagcaaggaaatgttggaaaaggccagagaaaaagtgccggccgcagaatttttagagagagacatgctggattttaaactgaatcatcgatataaagcggcggtcaatctctatggcagcatcggatttgcagaaaatttacagcgcatggaaaatggaatccgctgcgtttgggaatgtctggaggaagggggcgtgctgattctgacgccctggggaacaaaggaaacagttgcagaagagatcgtcgccgactgccgggagcgggatggcctgcagttttgccggatggaaaccgtgaaacgtgtttcaggggacaaagttgaagtggaaatgttccacctgatcggaaaaggattagccgtgcagcaattccaccacgttcagcacataacgcttttttcggaagaagaatacaaaaatgcactggagaaggcaggttttaccatccgtgcccgcctttcggagcaggaattccggatgggagcatttgtctgcacaaaatagcacagattaaaatcggggagcgcatttcgcgcttcccctgaattgaccggttcatactgcgaacaaagcgggcaaattatgcgctgccaaagcccatcacgtcgctgtctcaacacgtaccaccttcaaaataaagaccaattttagataatatccattaaatttatcttttcgatctcaaatgttaagtccatcccaaatcctcaagtctccagccaccacggcattttacccgacattgcttcagaacggtcatcctgtgttaacgttttccccaattttagagccagttctttcagctgcatccggtataaacccgctaccgttgcggtattgaaataaggctgtccaaagtggacggttgcctgccggtacacgattgttttaatttccctcatctccctgttttgttcatccggatcactgattccaagggccgcaagatcctcaaagaagctccgtttgtaaatgaatcgatactccttcaatcccaaaatggaccagagtgtatcgtaaaaaggcactttgtaggctttcagccagtcccacatgatctcagggtccgtcacatttgggttttccgcgtggcagcgggcgcaaaggagcaccagatttgcaggctcatccctgccgcccagagagtccggcacaatgtggcagcgctccaaattgcgtttgcagccgcagcgccagcagcgctcgtgggcctcggccgcgtccacgctaaagtctgattcatcaatgcgggagaaccaataatctacaatttctggtatttttgtcttgatcggtttacgctccataagtatgtattcctcctctgtaaaaagctacggtaaggaaaggataccagataattctatttatgtaaacggaaaatgccattccaaccgtatgtcccctctgtttcgccttgcaacctgtcccaaagccgattataataattcttatcttaaacaaaagcgggtgaccattatgtacatagcggatttacatattcattcccggtattcccgggcgaccagcaaggacctgacgccggaacagctggattactgggcagggcgtaagggaattcagattctgggcaccggggattttacccatccggcctggcgggacgaattgcaagaaaagctggttccggcagaggacggactgtacgcgctgaaggacgatctgcggctgagcgaccgcaccctgacagtcagcgggaagacccgttttgtcatctcaggtgagatcagttccatatacaaaaagaatggaaaagtgcgcaaggtgcacagcgtgattttgctgcccagccttgaggccgcggagctgctctcccgaaaattggaaactattgggaatatccattccgacggccggccgattttgggtctggactgccgggaccttttggagattaccctggaaatctgcccggaagccatctacattccggcgcacatctggacgcctcatttttcgttattcggggcattttccgggtttgacacggtggaggagtgctatgaagatttaacgccccacattcatgccatggagacaggcctgtcctcggacccgcctatgaactggcggctttccgcgctggactcctatcagctggtgtcaaattccgacgcccattccccgtcaaagctgggccgcgaggccaatcttttgaacattgaaatgagttacgggggcctatacaaagccatccagcggggcgacggtcttgagggtaccattgagtttttccccgaggagggcaaataccacttcgacggtcatcggaaatgtcacctctgccttagtcccgtggaagcggagcgttatgacgggaaatgcccggtttgcggcaaaaagctgacgattggcgtgtcccaccgagtggagcagctggcggatcggaaagagggattccagctggagggggcgcgtccatttgaaagtctggtgccccttccggaggtgattgcggcctccaccggccgttccgctgccagcgcaaaggttcaggttcagtacgaggaaatgctggctggcctgggaactgagttctccattctgcgggagctccccattgaggacatacgcgaaaacgcaggctatctggtgtccgagggcattcgccgtctgcgggagggaaaggtggagcgtctgccgggatttgacggtgaatacgggaaaatcaaactgttcaccccgtccgagatcgataatctggacggtcagctcagcctgtttgccggatggaccgcggatgaaaccgccaccgtggcagagccggccggagcggttcaagacacagacaatgacaacgtttccgtaccggcctcctcgccggcggaatatgtgccttcttccgggccggattccgatcctgaaaatttacaaagggctgaaactgccgcctcaaccgttcattttccgctggtcttaaatcccgaacagacgctggcggtccgttctgcgggacgggcggtcgcggtgatcgcagggccgggaaccggcaagacccgaacgctggtggagcgtatttcctatctgcttgaaacccggagggtgaagccgtcgcagatcacggccgtcaccttcaccaacaaggccgcggaggagatgcgcatccgtctggaagagaaaatgggcgggaagcaggctgtaaaaaaactacagatcggcacattccattcgatctgcttcgatctcttaagaaaacagggattggaatttttgatggcggacgagtcggaaatgctggaaattgcccgcgaagccattcgggcggagggactgtccataaaaccgtcccggcttctgcgctacatatccctcaaaaaagcgggcagcgccccggaagaggtggaggcggaaatgcaggaagcggagcaggaagaaatgcaggcgggacatgcgtccgcaccctcccagccaacccgcgcccagttggaagcagccgcggaaaattatcagcagggcctggctcagatcggcgcgttggatttcgatgatttgctgctgaaagcgctggagcttgcagcgcagtccaaaatggaaccggaagcattttcctatttgctggtggatgagtttcaggacatcaacccggttcagtaccgtctgatccgcgcgtggaaccgcggcgggagagagctgtttgtgatcggagatccggaccaggcgatttacagcttccgcgggacggatgcgaaatgcttcgagcgcctgggggcggacgagacgggcctggaggtgatccggctggagcagaactatcggtccacccctcaggtgctggccgcggcacaagccgtgatttccgtcaatcccggctcccggccttgtctaaaggccaaccgcggggaaggctacccggtgcgggtggtgaccgccacaggtgagatggcggaagccatatttgtggcaaaggaaatcaaccgcctgatcggtggaatcgacatgctggacgcgcaggaaggattttcctgtcccgatgaccgtcggcccagaagctttgccgaaatagcggtgctgtaccgcacccaccgccaggcggatctgctggaaaaatgcctgaggcgcgagggaatcccctatgttgtagcggggcgcgacgagtaccttgaggcggacagcgtgcgcggaaccatctgctttttccgctgtctggccgatcccagcgatgggctgtcgcggcggttgtgcctgaaactgctgtggggactgggcgaggactgtatttccgactgcgtatttcagtcaatggttgataaatataagaagcagattaaaaaggtccgcccgcagaaactgcttgattcatggatcgcggacctggacctgaccgaggacgcagccatgcaaaagcttgtttccacgtccgttttctacaaaaacatgtcggagtttctggaaaacttgacctttggccgggagagcgatctgaaacgctgcggcaaaaagagttacacggcagatgcggtgaccttgatgactctccacggctccaagggcctggaattccctgtggtgctgctttatggagcgcgtaagggcctgattcctctggaaaatggaaacggccggatcgatgttgaggaagagcggagattgttttttgtgggtatgacccgcgcaaaggaagagctgattgtaactacttccccggaaccatcaccatttttggatcatatgccaaaagaaacattcctggcccaacgcgcgaatccgccacgggagacagaggcggccaggcagttaagccttttcgattttatgtaaaggtttcccaggagaatgcagatgtcagaggaaaaacagaagaaaatcgatacggaaaagcaggttatgccggttttgaaacagctggaccgtttatacggaacaaccaagacgggattttttcatcaggaaccgtggcagctcctggtagcgattatgcttagcgcacagagtacggataagcaggttgaggaagtcttaccggagttgtaccggagttatccgaaagtggagtatatggcaaacgccccggtggaggaaattgaaaggaatatccgatccattggcctttacaaaagtaaggcaaaaaacatcaaaaagtgctgcggtcagatcgtgacagaatatgcgggtaaggttccggaaacaatcggggaattgctcaggcttgcgggagtgggccgcaagaccgcgacgctgtacctggcggatgcttacgggattccaggcgtgacggtggacacccatgtattcagaatttcccgccgattggggtgggcttgggggaagaatcccgcgcaggttgagctggagctgcagaaggtattgccggtcgattactggaaccgtattaattttcagttgatttaccatgggagagcggtgtgcacggccagaaaggcgcactgtgaaatatgcccgctggaaacgtggtgcgcgaaacgaatcgaggagaaaccgggaaaagcggcccggtgagccatcggcggagcgacacgccggttaaagtccgtcgaaacgaatttgagagaggtgaacaggtggaaaagtccgtgacaatcgaacgaaactatataccactgtgtcaggtgctcgcgcaggagccggtgatcacagccctgcagcgccgcggcatcaatatggtccagccggaaatgattcgtctgtcccggtcggagcgcacgtttgagcagtatatctgcctttttggcggggagaacctgccggaaatgcttttaactgggatacagcaagccctggaagcggcggataaaacagcgccggttttaatgacagagcagtatccctggctgaaaggatcgtcctggattttggaaatgcgggatgtgagccattataaagtgacggttcagtttgacgcggaaactttcgtcaatataaggagggtatgcagagaacaggaagcagcgggcgaattggccgatgtaaacggggctggttctgtggtattgcggttgtatttggaaaaggatccggcgatctatgggatggattgcaggcttgaaggaatgggtatgaaggtaccggtggaagcctgttccgatggcgaagtcctgaaaatcaccgtaaaagagtgggagactatgttgcggatggtaaaggaactgatattgaaaggaaaccttgatttgaggcgatatgcagcgggggagtgtgagatttaaaaacgggctataggagattgaaggcagtgggcggagaatcgtagaagacacatagtgcgaatcctaagtggacatgaaaatgcaggaggattcgcactggaaaattggaagtttatggggaaatatggtgcggtgaaaatataatggttgagttttcgagagaggaggggtacaatagggataagaaattgaagggaatagaaaaaaaattggtaatttttgctgtcgcattctgtgagggagtgcgtggattgaaatatatcattttgcccaaacttatcacccttctgggtcgcattctgtgagggagtgcgtggattgaaatacagatttcgtcaatttgctcttccgtgatttcgtcgcattctgtgagggaaatgcgtggattgaaataccaatatctagtccgagtatgtgaaagtttttctgtaactaaggttttataaggtcttctatggtaaaataaaaatcataggaggccttttattatggcaagagaaaagaaacccgtacacaaagtacaaatgacagatgggaaaaggaacattatccagcagctccttcaggagtatgacatccagtccgcagaggatattcaggatgctctcaaggatctgcttggcggcacaattaaagaaatgatggaagcagagatggatgagcacctgggctatgaaaaatcagaacgttcggacacggatgattaccgtaatggttataagcctaagcgcatcaatagcagctatggcagtatggacattcaagtcccccaggaccgtaaatccacgttcgagccgcaggtggtcaaaaaacgccaaaaagatatctccgatatcgaccagaagatcatttccatgtatgccaaaggcatgactacaaggcagatttctgatacgctggaggatatttatggttttgaggcatccgaagggttcatttcggatgtgaccgataaaatcatgccgcagattgaagactggcagaaccgcccgctttccgaggtatatccggtactctacatagacgccatccattactcagttcgtgataatggggtgatccgcaagcttgcggcttatgtgattcttggcatcaatccggatggacgcaaagaagtcctgaccatcgaggttggcgaaaacgaaagctctaaatactggctgtctgtactaaatggcttaaagaaccggggagtgaaagacatcttgattctctgcgcagatggacttagcggcatcaaagaggcaatcgccgcagcgtatccaaagacggaatatcaacgctgcatcgtgcatcaggtgcgtaacaccatgaaatatgtgtcggacaaagacaggaagcccttctgtgcggatcttaaaacaatctatcaggcgccaacggaagaaaaagccctggacgccctggagcgggtgacggaaaaatggagcgaaaaatatcccaattccatgaggagctggaaacaaaactgggatgccatttccccgattttcaaattttccacagcggtcagaagggtcatttatacgaccaacgccattgagagcctgaatgccacttatcgtaagctgaaccgtcagagaagcgtgtttccaagcgataccgcactgctaaaagccttgtacctgtctacgtttgaagctacaaagaaatggaccatgccaatcaggaattggggacaggtatatggtgaactgagcatcatgtatgagggccgtctgccggaataagccaatctgtcttatttttcacaggcggaatattcgcctgctcttgacatacaacgatagttgctgttatatataaaacaagggctgaaagtccaaaaaggaactttcagcccagtgattatcatagaagatcagcatttacagactttttttcacacactctctagtccttgcagggcttgttggtaagtcgcattcttgtgagggaatacgcggatttaaattttcccggcctaggccatctactggaacagcttattgtcacacactccatttttacgacaggctgtgcaaattgaaattaaaatctctatcccccaccctcctctcacaatctccacacacaaaaaagaactcctaactccctcatccccagttagcagttcttttattttccctcatcaattcaaccaattcaattcattctcaccaaatcgacaaaaccaccgctgcaatcccaatccctgcaaatataacgccgcccaatcttgtactaatccgatacagcgcggacggttcatctgcatagctggatttccattgttccgtcagcttccatatcacttccggtttcataaatgcaaaaacaccgattacgataaacacaataccccagatcatattccaaaccataacagcccatccttcccatcgccattttcccgggtgcctgaatccccaacacagaccccaaaaaatcgatcgaaaatcgatccccaatcaatcatcaatccccaatcaatccgaacccgccaaatcccctccatccccttcccatcctgccaaagcacgcgtcacttcccgttttaccccctccacatccgcctcattcggatgccccagagccctatcataattctcaatcatttcccgtaccttacatacatccccgcccgtacctaccatcccctcatatcgtttccgcaccgccgggagcatttgtccctggcacatgaacgttcctgccaggcggcatgacccatccaaatattttccaacattccccagaattttcgaaaaatattccctgcttcctccaaaccccgccgttccaaacaaaaatacatcctttcccacaatcccgctcagaaatcccgccatctcctcatcgcaggaccctttatccgtccagaatccggcaaacaccacatcggcctgcgcgacctcccgttccgccccggaaaccggtccgaagtacacacagctttccgtcggtaaaacgctgcggattccatccgccagcagcttcgtgttcccggtgcggctgctgtaaacaatcgtatatgttatacagaacacctccaaatcaatgaaattacacctgttcccggtcaaatacacagtgcacgccctcgtgccgctggatccctcccaggcagtcgcggttgcagcgaacgcattgccgcacagcgccggtatttccttccgtcaccttcctgggccagtccgggtcggccaggagctggcggctcatggccgcgcagtcgatgcgcccgctttttaactgtttctccacaaagtccgggtccgtcaatccgcccaccccgcacaccggcaggtgggtaaggctccgaacttcatccgcatagcgcaggaaacacccctggccggaaaaatagggatgattcgccggcgggatcgtgtcggacagccgggagtgatcggcaagggccacatgaaagctggtcgccccggcctgctccagcagcggaatcaggaccggcagttcctccacaagcacgcccgcgttgccataatggggctcctcctggcgcaccgccagcttgaaatcaatgggcatgtccggcaggctgcggcggattgaagtcacggcttccactgcaaaacgcgcccggttggctacgcttgcgccgtaccggtcctgacggcggttgaacaggggagaggcaaagctgccgcacatccgatcgccgtggacctgtaccatgtcaaagcccgcctttcccgccaacacggccgcagagccgaaggaagcggtgatccccgccaccttctcggcgggcagagacgagatatagggaccgacccgctggttcaaaagttcccgcagctggtccatggagtaccgcttcgtcaaaacgcccggaaggtatcgaaccattcccgccaaatcgctgtccgactggtgcagctgggcgcaaatcaaacagccttcccggtggactgcctcgcacagacggcggtaccgggcaaaccctctggcgctgtagagcgagccgaagggcgaacgcccggcgggcacatccccgacgatgatcatagcgcagccgcccgctgcgatgcgccgcaatttctccaaaagacgttcttccggcaggccaaatgaggtgggcgcgaagataatcctgtttttcaacacaagtccacccagattcaccgggcttgcaatcgtttcatagcccatgctcaggttctccttcctcacaagttccgcggcggtcctccgtcagccgttccaaaagtgaaaacaggatctgccgatcctccggttccagcccgcttaaaatctcccggtcccactggaaaaacagcgcgtggctgagatcgaaagcctcacgcccttttgcggtcagctccagaatgtgggccctgcggtcccggggattcagcttctggaaaatgaacccggcctgttccagtcgggttagagagcgtgccacgtggccggaatccattttcagcgacacagccagttccctgggagagcagccggggtgtttgccgatgtagaggatgaaaaacagcagcccctgggacagtccgatttcctccagcttccgcccgcagtattccgtaaaatccttgcgcagcagcgtgataaaataagcgaatgaacgaatcatcagaatacctccataaatatttgacttagtcaagtatattgcaaattcatgactaagtcaagtaaaataatccataccaacgccgtggccattgaaatgtattttgctcccgcccatgtgcattgccttcagtaattcgtcaggtacaaatcgttcagccgtccataacagctcctccatagctcgcaagcgccctgtcacattccaccgcaaaatggacagccagctatgcctggacgctcccccgtacagtccacaggcatcccacccatccagcccattctctccactctgaattgtctaaaatataacacatatccccaatgtttcattggaaattaacgcaaatactccatctgattctaacattccccttcgcttcatataaaatatgaataatttaaattccgctattgacattccggttatgcaatgttaatatgaaggaaacattaaggtaagattaagattacattaaggtaaagaaaaggagaggaaagtatgagaaaacattcaagagcgttggtagcattggttctgggatccagcatgattcttggcgcttgttcgggcggaggccaggcggcatccacagaggcgcccaaggcggccgagaccacagcggctccggagtcaaaagcggaggagtcgaaggctgaggagaccagcgcagaggctcagggcgggaagatgtcccacgacgaattagtggaagcggccaagaaggaaggcaagctggttgtttactccaccacgtcccgcatatccaccgcggctgagaattttgaaaaactttacggaatcaaggttgagaccgccaacttaaaggacggcgagctggttgagaaaatttccctggaggttggcggcggcgtcaacggagccgatatggtgctctgccaggacggcgccagagtctacggcgagttaatcactcccggctacctggtgaactacgttcccgagaccctgaaggaccagattcctgaggagaaccagaatccgctggtattccagtttgtggataaggtgttcattttcaacagtgagaattccacggacgctcctgtcaccaatatctggcagctcaccgagccggagtggaaggaccgcgtgcagtttaagaaccccaaccaggagggcgtgaactccaacttcctgaccatgctgaccagcgacgagtggtccggcaagattgcggacgcttacaaggaatattatggaaaagacattgagctgaccaccgagaacgcaggttacgagtggatgcaggcattctttaacaatacggttttaggcaccagcgattccaccatcgcggagaacgtgggaaccaagggacagaaggaccagctgatcggactgttcgtgctctccaaaacccgctacgttgagaccaaagacctggccctggcgcccgccccggatatggcccccttcagcggcttctactatccgatttacgcgcagctcacctccaacgcacagaacgtgaacgcggcgaagttgtttatcgagtacctgatgaccgccgaaggctttgagccctggtcctccgacgtgggttcctactccggcaacctgcaggttccctgcaacccggccgacaaggatatgacctactgggcgcccagactggtccgcgaggatccgcagtacgtgtatgagaaccgcgctcaggttgaggagttcgtcaacaacctgatcaactaattgaaacagtcaacaattcatgccggccgcctgaaaagacggccggcactcagataagggggatcgattatgtcatggcagaaccggtttaagtcgtttatcaaagagccgcagaacatcatccttatcgtgctgtttattctgatgtcctttctgaccctgctgccgctggtgtctctgatccgcgatacgctgatcgcccatccgtccgagctgatgagcatcaagggagccaaggccggggatttcacactgttccactggtacaaggtattctttgacggaaagaacagcaaaaatctgttctacagcccgttctggaacacggtcaaggtttccatcggcagctgtgtgatcgccatcggactgggcggcacggtagcctggctggtggcccgctccgatatcaggtttaaatccattatcagcacgatttttgtatttccgtacataatgccgtcatggacgctggccatggcctggctgaactttttccgcaacgcgtacatcggcggcaagcccggtctgttcaccgccctcacggggattgagacggccaactggttcgcctacgggcagttccccatcattgtggtgaccggcctgcactacgcgcccttcgcctacatcctgatcggcggaattttacagaatatggatgcgaacctggaggaggcggctatgctgctcaaggccagccgcatgaaaatcatccgcaaggtgacgctgcccatcgtgatgcccgccatattctccgcgttcctgctgaccttcgccagctccatgagcgcctttgcggtacccgcatttttgggcaccccggtgcgctactacgtgctgacgacccagctctaccggacgttaaacggcgtgaaccaggggtacggctatgttctggccgtggttatgctggcggtggggctgtttgtcctggccttcaaccagtggtttgtgggcaaacgcaaatccttcacaaccgtcaccggaaagagctcccaggtctccctggtcaagctgcgcggcgccaggacgcccatttccgtaggcgtgctgtttatgttgctgctgatcgcgattctgccgctcgtctccttcgcggtggagtcctttaccatggtgaccggcaattacaatccgtccaactttacctctatcttctggctggggaagggaagcacggatatcgccaacggcgagccgggaatcctgcgcaacaagtacatttatctgggcctgtggaacagcatcaagttgtccgtgtgctgcgcctttgtggcaggcaccgccggcgtgctctgcggttacgcggtagtcaagcgcagaggaagccgcctgtcgggcgtggtcaacagcctggcgttcttcccctacctgatgcccgctatggccttcggcgccatttacctgtccatgtttacccagaaaaacggcttcattccgccgctgtacggcacattcaccctgctggtgctgatcggttcggtcaaatacctgcccttcgcctccagagcgggcgtcaacgccatgctgcagttgagcaacgagatcgaggaggcggccgtgattcagggcgtgagctggtggaagcgcatggtcaagatcatttttcccatccagaagaccagctttttgagcggctatctgctgccctttatctcctgtatgagggagctgtccctgttcatcctgcttgtcaccccggccaaccgcgtgctgaccacgcagctgttccagtacaatgaaaagggctggaaccaatacgccaacgcgatcaaccttctgatcattgtggtggtgctgtttttcaacctggtgatcaacaagctgaccggagcgtctattgacaagggaataggaggatcataaattatgtcggatattgtactgaaaaatataaccaagcggtttggcaagagcgtggccgtggataatctgaatctgaccattgcagacggggatttcatcaccctcttaggccccagtggctgcggtaagaccaccaccctgcgcatgatcgcagggctggagacgcccaccgagggcgagatctggatcgacggaaaatgcgtattttccgccgagaaggggattaacgtagcccccagcaagcgggacgtgggttttctgttccagaactacgccctgtggccccacatgaccgtataccagaacatcagctttggcctggaaaatatgaagtggcccaaggaccgcatccgcaaaaaagtggatgaactgttgaaaatgctgaagatcgaggagtttgagaaacgttatcccagcgagctctccggcggccagcagcagcgtgtggcgatcgccagaaccctggcgacggagcccaaggtgctgttcatggacgaaccgctgagcaacctggacgccaagctgcgcatggacatgcgcacggagctcaaacgtctgcacctggagaccaggtctacctttgtgtacgtgacccacgaccagctggaggccatgacattgtccaccaagatctgtctgatgaagaaaggcctgctgcagcagtatgcgccgccgcttacggtttaccattccccggccaatatgttcaccgcggacttcgtgggaaatccctccatcaacctgatcgagggcgtgggctccaacattaacctggatgaaatcaagatacaggtgggggacttaaacatgctgttctgtccggagtccaacagcgtatctctcagcggcaatcataaaattgtgcttggaatccgcccggaatatgttaatatagaagcagacagcgcccttcaggcatcgatttattccacattgccgtccggcatggaaaccattgtgaaaatccagctgggggatctgattctcactagcgtggtgttccagggtaaggatttcaccgtaggtgaaacggtgggcgttgaatttacgggtgaacgctgcgttctgtttgacgctgaaacggaagactacctggcgcttggccggttggaggttatcgccgggtgattcccgcccaggggagaggattgcatgaagaagatactgattgtggatgatgaacgggatattgttgagtgcctggatatgaacctgcgcaagaagggctacgctaccgccttcgcctacgacggcacggaggcggtgctgacggccaggcgggagcggccggactgcattttgctggacgtgatgctgcccaagatcagcgggatcgaggtgtgccatctcctgaaggcggatcaggccaccgggcacattccggtgatcatgctgacggccaagggcgaggaggacgacaaggtcaccggctttgacgccggggcggacgactacatcaccaagcccttcggctggcgggagctgttcgcgcgcattgaggtggcgctgcgccggagccagccctccgctccccagagccaggaggacaacgccctgcgcgtcaaggatctggccatctatccggataaatacgtggtggagcaggacggcaggcgggtggatttgacgcccacggaattcggcatcctcagggtgctggcggagcaccggggaaatatcgtcacccgaaacgagctgaacgaagccctgggaatcaccaacaacggcggggagatccgttccctggacgtccacatgagaaatcttcgcaaaaagctgggcgacgacatccaggaatgccgctatatcgaaaccatacgaaggatcgggttccgcgtaaatgagtaaaattgatcggatcatgaccatcggcctggtgatcttctggctggtggtcctggtcctgattctgttttgtgtcctgatccgggaatatctgtattttaagaattatatttcggagctcgagaagcgcaatcagaagctggagacagagattgcggcccgggaaaaacgcctgcgggacatgcgggcctcggacgacgaccgtttcaattattttaacgcggtgtttgccgccatgaaggacggcatcgtggtgtttaaggacgacggcgagctggtgctggtaaaccgggccgcccgggcgtttctgcatatcgacaagcatattttttttaagagcgacaagagctcctacggggctttttacgggctggtgtccgacgtctgccggcaggcgtttgagagcgcgacggagcggcgggtcgagtttcaggagggggaccggattttcgaggtgtccgcgcttttgataccggaccgttaccagaaggggatctgtctgggcgtgatggcggtggtcatcgacgtgaccgaggccagacggctggaagcccggcgcaaggaatttgtcagcaatgtatcccacgagttccgcacgcccatgaccctgatttccggctacgcggaaatgcttcggatgtgggacgaggtgacgaaggaggaacgcaccaaggctctggatgtgatcgagcaggagaccaagcggttaaagaagctggtcagtgagcttttgaccctgtccaggctggaccgccaggagggcgaggagcgcaacctgccttttgtggatgtggaggcggtgattgagcagattctctggagcctggaggacatggcgaacaagcgcagggtggagctggtctccgacgtggaggtggattacccggtcctgcgggcaaacgaacagtttttttaccagatgctgttgaatctgatcgagaacggtatcaaatacaaccgggagcagggacgggtgaaggtgtgggcccgcaatgacggaaacgtcctgcggatcacggtgtccgacagtggaaggggcatcgaagagaaacatcaggagcggattttcgaccgcttctaccggatcgacgaggaccggaattcccgccacggcggcaacggcatcggcctctccatcgtcagcagcgtggtggagcagatgcggggcagaatccgggtggagagccgcccgggggagggatccgaatttaaaatcgagctgccattaaacggcggaactttaggaggataaagtgaacgtattaattgtgacgggccttagcggtgcgggcaagaccagagcgctgcagattcttgaggatatgggatattattgtatggataatatttccccaaagattcttttgcagctgatccacggggagatgcaggaggaaggattttccaagcgtctggccgtgaccatggatatccgcagctacggcgtgccggacggattcgaccagatcgtggatgagatgaagaaatgcagcgtcagcgtgcgggttctgtttctggactgtacccaggaggtgctgttaaagcgctacaaggagtccaggcggctacatccgttgatgagcgggaaccgcaatgtgaatctgacggacgcgatccggcaggagattttccggatggagagcctgaaggtggaggcggattatgtggtggacacctcggagctgtccacgtcggcgctgcgggagaagctgacgtatctgttttccgggccggatgtggcggggatgcggattgagtttgtggcctttgggtataaatacgggattttggcggacgcggatctggtgtttgatgtgcggtgcgtggcgaacccgtattatgtgaagggactgagggaaaaaaccggggaagataaggaagtcagggacttcgtgatggggtatgaggaggcgagggaactgtttaagcgtatggtggggtatctggagtatgcgattccattgtatgagaaggaagggaaagcgcagctggtgatcgggctggggtgcactgggggacagcatcggtcggtgacgtttgcaagcttgctgagggatcattttggggagaggtatgagaatgtgaggttggggatgagagatatgagggtgaatcagaggacgattgtgggggagggggcttagaagagtacgcgaaagagcgggcggcggacccatggtttcccgggactgcttaccgaagcgcaggcgctaaaggccggaaaggaccggaagcggggcaccggctccattcgcggagaaactctgaagagctttctccgctcaggtcgcctgaaatcgtgttttggagaacacgatttctccccgcttccggcccttcccggccttaagcgcctgtggtccggtaagcaatgtccccggaaaccatgggtccgccgcccactccttcgctggtttttcagggcggaaggggggagggagctgggagttggcgggggcttatttttttttgcgcttttttgggatgaggagatggggatgaggggttaggggcggtggtggtgtagtttggcgcaggggtgggggtggccttggatggggaaggatttgtcgccggtggggtcgcggtggaatccggcggactcgtagcagcggtaggctgcggggttgtcaaggaagacgtagagggtgacctggtccgcgcagaggatgtcgtagctgtagcgcagggcctggagaaccatggtacggccgcagccctggccgcgcagggcagggtccaggatgatgaagcccaggtggacggtgttggtctccgggccaaggtagcgcatggtaaaatggccgacgggccggttgtccccgtctgtggcggtcatcagccataggttgggattgccggcctgccggtcatagtattcgttgagatgctccggacggagcggatatccgaattcgcagagggcgtcggcggaccagagacgcagcgcgcgctcatctttgctccaggtgacgatcttttcggcatcggttttgttgtatggtcttaaacgtatcattggcagtgattccccttttatggaatgatattggttttatgtgcgtcgccggcctgggaggcggcggtactggttagctgcgggaattcacaatttcccgcacggcgctcaggaacaggcggcggtcgatggggtggatgacgaagtgggtgtagccgtgctggctcagcctcaggaccgcctcgtccacgtgctggcggggcgcaatgaacagggtgatttgcatgagcgggccggagagggtcttttgcagattcatgatttcatcgggcggaagttccaggtctacgatgatcagcttgggatttaaccggtagatcataggaaatgcctggcggctgtccgcggcggtgtaaatgtgcgaatatccggcctgtttcaggatgtcggtcgtctggcagcaaatttgcgcgttggttgagagaatcagaatgttacgcataatcgtgtccccctttctgtacctctattatactacaatcaggctctaagcgatagaatggatgcggaattgatggaaaataattgtgaatgacgggtggccgtttggggggatttatattataatggaatggcgtccggccggtggagccggagaatatgaaatgggccgcagacggtttttgcggcatggaggttgtgatgggaaaattgagattgggaattcttggaaatggttatctggcggggattgtggtggaggcctttgagaaggggctgctgccggaatatgagctggtggggataatggggcgcacgccggagaaaaccggggcgctggcagagcgggcggggtgcgcgccctgcggttccatcggcgagcttttggaccggaaactggattatattgcggaggccgcttccgtggccgcggttcgggattatgcggtgcggattctggaggcgaagtgcgggctggtggtgctctccatcggggcttttgcggaccggagcttttatgagcaggtggaaaaagcggctgcggccaacggggcgagagtgcatatcgcctccggcgcggtgggcggcttcgatgtgctgcgcaccatcgcgctgatgggacaggcgaaggcggggattgagacacacaaggggccgaagtcgctgatgaatacgccgctgtttgaggagtctctgctgaccgatggcgaggagagacacgtgtttgaaggaaatgcaaaggaggccatcggccttctgcccaccaaggtgaatgtggcggtggccgcttcccttgccgcggcggacccggagcgtatgcgcatggatatttacagcgttccgggctttgttggggacgatcacaggattacctcggagatcgacggggtgaaggctgtggtggacatctattccagcaccagcgccatcgcaggctggagcctggtggcggtgctgcgcaatctcgtgtccccgattgtgttttaagagcgtctgaaagaggaggaaatgatatgtttcggaagatcgtggccattgagccggtgagcctggtgaaagaggcggaagaggaactgagaacgtacgcggaggaagcggtgttttatggggatatcccggcggatgacgaagagatcgtgcgccgcatcggggatgcggacggggtgctggtgagctatacctccagaatcggccgggaggtgcttgagcgctgcccgcaggtccgctatgtgggaatgtgctgcagcctgtactcggaggccagcgccaacgtggacatcgcctatgccagggagcgcggcatcacggtgctcggcatccgggattacggggaccggggcgtggtggagttcgtgctctgcgaactggtgcgcattctgcacggctatgaccgccccatgtggcgggagctgcccctggagatcaccgggttaaagacaggcattatcggcctgggcgtgtccggggcgatgatcgccgatgccctcaagtttatgggcgcggacgtgcgctattacagccgcacccgaaaggaggaccgggaggcggcgggcctgcgctaccagcctttggaccggctcctgcaggaatgcgacgtggtgttcacctgcctcaataagaacgtgattctgctggatgatgaggcgttcgcacagttgggaaacggcaagatcttattcaacacttccatcggcccgggccacgatgtgaaggccctggagtgctggctgaacgcggggggaaatacctttgtgtgcgacacggttggcgcgctgggcgatccggcgctggccaagaatccggccgtaatctgccccggcgtatccgccggacggaccgcccaggcttttgaattgctgagcaaaaaggtgctggataatatccgcacgtttttgggagaacaataagggattgtaaaaaaacacgttttagactatactatatggaacggcgccggcagcggccccaccgggcgggcgcggattcatccccatttttatcaaacgaaacagacagaaggtaaggcattcgcactatgacaaacgatatgaccaccgggaatccggtgaagttgattatctattttatgatccccacctgccttgggaatattttccagcagttttataacctggcggactccatcgtcgccgggcgatttatcggagtcaacgccctggcggccatcgggagcaccagttccctgattttcctggtgatcggatggctcaacgggctgaccagcgggttctccattctggtggcccagcatttcggggcgaagaaatacgaccgcatgcgccattacatcgccatgtccattttcctgtgcatcctgtttgtggtggtgatgacggcatccctggaatattttaattatcccatactgcgcctgatgaacgcgccggatgagatcatcggggacgtgggggcttacatggcggtgatctacgccgggctggcggtgacggccgcctacaacgccctggccgcggtgctgagggccctgggggacggcaaatcgccgctgtactttctgatcatctccggggtgctcaacgtgatcctggacgtggtgttcatcgtgtatttccacatgggcgtggtgggctgcggctacgccacggtgatcgcccaggcggtgtcggcgcttttgtgcctgatctatattatccggaagtttgacattttgcggctcagcagacaggatttttcgccggatctgcgggctgtgggccagctgctaggcatgggaattcctatgggcctgcagttttccatcacggcgatcggcaccatcatcgtgcagggcgcggtcaatgccttcggcgccgtgtatatcgccggattctccgcggccggtaagattcagagcatggtatccaccattttcgtgtccttcggcgcaaccatcgccacctatgtgggacagaaccggggcgccggcaatatcgaacgggtgcaccagggcgtgaaggtcacacagattttggtgtttgtctggagcgcggtgatgatcgcggtgatccatttcgcgggacagtatctggtgaggatttttgtggacggctctcagaccgacgtgctgaacgcctccatggtttattttaaaacagtggcatggtgttatccgtttttgggtagtattttcttatacaggaatgcgctgcagggactgggctacggcctggtgcccatgctgggcggcgtctttgagctggcggcccggttcgccgtggtggcggccgtggtccggcccttcggatatgttggcgtgtgctttgcggacccggcggcctggctggcggcgctcgttcccatcgtgccctactatttttaccgcatgaggaaataccgtccaaggcccgtgcagcgttagcgccaggcaaaacgtttggtctggccgtgcgacagccgctgcggcggccggagggcggtaccggattgcccggagcgcatttgcggagaacagagagatttctgcgtcgcggttcaccttgtgagtcgcagcgcttatacaacacagagagaagaaaggaacagaacatggcagattttaaatcactgaaaaacccggacctgattcaggcgttccacctggtacagtatgatcccaccccggagcgccagggagaatttatgcaggaggttgtgaaggcgcgctatctgacagcggcctcttttagccccgagccggatgtggacgaggagggcaacttaaagttcagcgaggacgcgaccatctccttcccggacatccacaacgacaagggggaaaaatttttccccgccttctcggactggaagtccatgcagaagtgggagctgagggaaggccagcatgtggtcggcatgacctttgacgattatgcaggtatggttctccaggacaaggacgccgccggtttcgtgatcaatcccttcggggagaacatccgcatcgagcgccaggtgatcacagctctgaaacagcagcaggccgcctacctgaagcgccagcagctgacctacgagcgcaaccacccggagcaggcggcatccaatgagcccatggaattccacgagctttccagctatcccgagaagatgctggaggagattaccgagttccttaagcagcagccggtgaaaaaggcgtacatgcagggcgtgatccagggagaccgcaagggctgcatgttcattctggagcatcagggcaaggacgaggccattttcgggggaatcgcccgcatcgcgcagccctacatgcagggcatgtacctgtatatggccacgccggtttccgatctgggccaaaaggcaatcgagggcctggagccgttctacgagctgtaaagcggggaactgtgagagatggaagagaataaactggcggtaaagcccctgggccttctgatgctggagttgtcgatcccggctattatcgcgcagctggtgagcatcatctacaacatggtggaccgtatttttatcggccgcatcgagaacggcacaaacgctatggcggccctcagcgtttccctgcccgtcatcaccctgatcacggcggtgacgcggcttctgggcatcggaggagcgccgctttgcgccatcaaaatgggacagaaaaaccagaaaggggcggaggagatcctgggcaccagcttctcggccctgatcgcggcgggggttatcatgaccgccgcgattcttttgtttcacgagccgcttctgctgctcttcggcgcggatgagagcactctgggtatggccgcggagtatatcacgctgtacgcgttgggcactgtgttcgtgatgatcgccctgggcatgaattcctatatcaccacccagggattcgccggaatcggcatgtgcacggttttgatcggggcggttttaaacatttttctggatgcgctgtttatcaacgtgttccacatgggcgtccggggcgcggccatcgcaacggtgatcggccagggcgtgtccgcagtctgggccctgcagtttttgttcagcggcaagagcattttgaagatccgaagaaagtatctgaaaatccggttaaaggtgctgctgcctatcatggcgctgggcatttcgccctttaccatgagcgccaccgagggtctggtgcagatttccttcaacaaccagctgttaaaatacggcggcaccatggcggtcagcaccatcgcggtgctgttcagcctgtggcagttcgtgaccctgcccgtgcagggcatctgccagggggcccagcccattctcagctacaactatggggcggggaatttcaggcgggtgcgtggcagcttcaagctggccgtggtgctgtgcctgggttacaccgttgtgatgtccgtgatttttatggcgattcccaggggattttcacagatctttacggaggacgagcagcttttgcggctctgcgcatgggcgcttccgctgtatgtgatcggcggaaccaccttcggggcgcagatttgctgccagcagtcctttatggcgctgggacaggcaaagatatcgctgatactggcctgcctgcgcaaaatcattctgctggtgccgctgatctatatcatgccggcggcgttcggcggtctggaaggcgctgctaagctagcggctccggtggcggacctggtcaggcagcccggaccggtggcgacgatctttttggcggaatctgtctccgatgtgctggcggctctcagcacctccattgtgtttgcgggattttacagaaaaaggcttgcggaccgcccttagcgggcgggaacgcaagccttttgcaattttgcaatattgattcggggagattggattcagtctgtgttcagcgttcgtccatgttgctgcagaacagctttacatatttgaacatcagcgggatgtaggtggtgacgaatacggctgcggccacggcgaacaccggttttttcttctctccggccactgacagcccgaggcagatccccagtgagagcaggcagagtttcagggctgcgagcaccttccagtcggattcctgaatgtactggtcggcgtaatcaaagaactttttcattgcaacacctcctagtgtctggtacgatggtgacatggattggctgtcaactatattataccataaaccctaagctggcggaagaccccgccaggtgtttctgcgtgtattcgcgcccctacatcaccggcgtgctgaccagatcgtccagggatttgaaggtgtatcccatctcctcgtacttggtcagcagctcatccaggatggcggcgttggtggaggaagtgctgtggagtaaaatgatggcgccgggatggacgcggcccagcagcttcttgaaggcttcctccttggtgggctgcttatcctgaatccagtccacataggccaggctccagaagaaggtcttgtatcccatctcgttggccatcttcagattgctctcgctgtatttgccctggggcggccggtagtatttcttcatgggctggcctgtggtctgctggtacagtgcttccaggtcgttcagctccttggcgaaggcgtccttggtggagattttggacatgtccgggtgatggttggtgtggttggctacggtgtgaccctcggccaccatgcgctttaccagatccgggctggtggagatgtagttgccgaccacgaaaaaagtggcgggcgcgttgtgcttctttagggcgtccagaatgggagcggtgttgccgttctcataacccgcgtcaaaggtcagatacagcaccttgtcgtcggtattctggacatagtaggcgccgaactgctttagatagtccggggtggcgttgccgacgggagtctggccttcctgggggaagcttaagccccagttgccctccgcggaggcggacacggctttttctctgcgggactgcacgaatttgcctgcgcctgcgcccacaaaaaaggccatggtaaagatgagcagggtgcccgccagatgttttaaatgtttgcgtttcatatggatgatcaccggggtggttttagtttaagtatattgggcgttggaccggattatgcgccggatatgatttgccggaaacgggaatactggaaagagagtgtgcagaggaggaaaagacatgtgcagcagattctgtattgatcaggaaatgtggagggagttaaaagaactgttcggggacctggaccggatgttttccggctggaaatggaaccggagcggacaggacatccggcccaccaaccagtccctggtgattacggccggggaggacaatcgtctggcgcccgcgctgcagcgctggggcctgccggattcctaccacaagagcacgatcatcaatgcccgggccgagaccgccctggaaaagcggatgttccgggacagcgtggcctcccggcgcctggcggtcccggccgccaggttctatgagtgggaccgggagaagcagaaggtggccttttaccggaagggccggccggccctgtatatggccggtttttacagcccgggggaagacggatggaatttctgtatcctcaccacggaggccaacagctccatgggcggcgtccacgaccgaatgcctctggtgatcgagcgggaacaggtccgggactggattctggacggggaccggaccgcagagttcctgacggggcggccgccgcagctggaccaggagcgggactacgagcagctctcgctgttctggtagtgcgttctctaaattcaggtgctatatgcacacgaatttagagaacgcactactgggcttcgtcagctttccagattccggcagatcttctccaggctccggtacagctgatccatctgcgcatcgtcaaagtcgcggcagatgcgctcatccagctccgccaggatctccagaaccttgtgcgcctcctccaccccggactgcgtcaggcagaccaggaaggaacgacggttgcccgggtcccggcggcgctccagaaagcccgcctcctccagccggtccagggagcgggacatggtggtcacgtccacatggcaccggtcggccagctctttctgggtgatatgatccgcggccagcagggattccaggatgcgcacgtggccctggccaaggggcaggccgatctccgcgaaatagggctgcagaaccgacttgcgggcccgctccgtccggaccagcattttccgtatctcttttttatcaatcattcccatacttcctttccatttgcagagccgccgggcctgtgccctgccgaattcttcaatcggttctctcgcagcgttttcttaaagtataccacgatccggcttcttattccaactcaaactgtcccgtgtacagcttgtaataccgtccctgctgctccaacagctcctcgtggctgccgcgctcgatgatggagcctttttccagcaccatgatcgctttggagtttcgcaccgtggacaggcggtgggcgatgacgaacaccgtgcggccgtccatcagcgcgtccatacccttctcgatcagcttttccgtccgggtgtcgatggagctggtggcctcatccagaatcagcaccggaggccgggagatggcggccctggcgatggccaaaagctggcgctggccctgggacaggttgccgccgtcgctgtgcagcaccgtgttgtagccgtcgggaagacggcggatgaaggagtgggcgttggccaccttggccgcggccttcacgtcctcgtccgtggcgtccagccgcccgtagcggatattgtccgcaatggtgcccgtaaacaggtgggtgtcctggatgaccacggagagggagcggcgcagatcgtccttgcggatgttgcggatgtcgatgccgtcgtaggtgatgcatccgccgccgatctcgtagaagcggttgatcaggttgatgatcgtggtcttaccggcgcccgtggagccaacgaaggcgattttctgtcccggtttggcgtagaggctgatgtcgtttaacacctttgtctccggcgtgtagccgaacaccacatgttcgaagcggacgtcgccttttaaggggaccagggtgaaggagcttccgtccgcagaggggaccttccaggcgtgtttggggctgtagccgtcgcactccgacagagcgccgtctgcattttcccgcacattgcacagggtcacgcggccttcgtccacctccggctcctcattcatcatctcgaaaatgcgctcggcgccggagagagccgccagcaggaagttgatctgctgggtgaactggttcatgggcatcgcgctctggcgcacgtacaccaggtaggaagccacggttcccaggtccgtcagcccggccatggcgaagaggccgcccacgcaggcggagaccgcgtagtttacataggagagggacacgatggtgggaatggtcatgccggagtaggtcagggccttggtggaagccttgcggtacgcctcgttgcggcggcagaattcctcgaagtcctggggctcgtggttgaataccttctccaccttctgaccggccaccatctcctccacaaagccgttgatactgcccaggtatttctgctgccgggtgaaatatttccggctgcgccgcccgttaaagcggataaaggccatcataaagcccagaaagacgaaaacgatcatggacagccgccagtctaacaccaccagcatgatcagggttccggtgatggtgatgaagctctggatcagcatggtaaagctgccgtttagcgcctcggtgatggtgtccacgtcgttggtgaaacggctcatgagttccccgtgggtgtgggtgtcaaagtagtttaagggcaggcgctgggcgtgggtgaacaggtcgaaacggatttcgctgaccaccttctgggtcacgcggaccatcagctggttgtaaccgtagcaggacgcggccccggttaggtagagtccggccatgaaaataaccatccgggccaggcccggcagatcgccgggaatgatataggtgttgatcaccggttttaagaggtaggtgccggtgatattggcccccgcgctgacggccaccagagccgcgatcacagccatggtccaccggtggcgtcccaggtagcgcagcatctgcgctatggttttttttgtgtccttgggcctgctgaaatttgttgttcttggcattacagattcgccccttcctgctgagaataatagatgtcctggtagatctggttggaggccaacaaggtctcgtggctgccgacggcgttaatacggccgtcctccagaatgatgatctggtccgcgtggagcaccgaggtgatccgctgggcgataatgattttggtggcgccgggcagactctcggccaggccctcccggattttcgcctcggtggcagtgtccacggcgctggtggaatcgtccagaatcaggaccttgggctttttcaaaatcgcccgggcgatgcacaggcgctgcttctgtccgcccgacacattgacgccgccctggcccagctccgtatcgtaaccgtgttccaggcggtcgatgaattcgtccacacaggcgatgcggcaggcttccccgatctcctggtcggtggcgttttcacgcccccagcgcaggttggctttcaccgtgccggagaacagcgtgtttttctgtaaaaccacggcgatggaatcccgcagctcccgcaggggatattgctgcaccggaatcccgtcgatatagatctggccggaggtggcctcgtagagccggggaatcagttggatcagcgtgctcttggccgatccggtctggccgataatccccacggtctgccccggctcgatgtggaaggagatgtcggagagcacgtactcctccgcctgagccttatatttgaaatagacgtggtcgaagcggatgtctccgcgctccacccggatatcctgtgcctggtcgtcccggatatcgatctcctcgtccatgacttcggagatccgtttccaggaagccagggaccgggtcatcatcagaaacacgttggagagcatcatcagggagttgagcacctgcatcacgtagctgaggaaaccggtcagctcgcccaccttgagaccgcccaccgaggctaagtttccaccgaaccagaggatgcttaagatggtgccgtagaggatgaactgcatcaccggcatattgagggcggccaggcggaaggcccgctccgaagtgttttgcaggttggtgttcacctcgtcgaatttctggatttcgtagtccccgcggacgtaggatttcaccacccggatggcggtgaggttttcctgaatcacccggtttaccaggtccacggacccctgcataaggccgtacagggggcgcacatgggtgacaatgtaaaagagtatggcgcccaacagcggggcggccacaaaaaacaccagggccagcttggcgttgatggtaaaggacacggtcagggcgatgagcatcatcaccggggagcggaacgcaggtcgcatgcccgtggacaccgagttctggatggttgtgacgtcgctggtcagccgcgtgaccagggaggaggttcggaatttgtcggtgttggcaaaggagaattgctgcagcttctggaattccgccttgcggatctcggcccccagcccttggccggtggtggaggcgaagtgggcgtatccctggcccagcgccaggctgatcagggcgaacagaaccatctgaagccccttcatcaaaatgtaacgccggtcgccgtttgccacgcccacgtcgataatctgggccatcaccaggggaatgaccagctcaaaggcggcttccgcctcgatgcagagaacggccagcaccgcctgtctgcggtaaggctttaagtaggagagaaacgttttcatgaatggttttcctttctgagcagaagttcgcgcctgcggcggtctgccaggcgcggtaagtgaattgctctgacaattattgcacatacaactattgtatgtgcatgaattgagattgtcaatctgaattttttcattacgtccctcctgctgaatgtgccgggaacgtgaacattttcaggaccgcggtttcaattccggcaagtttgtggtattgtatgaacacttgacgaggtcataacgagtctagtgagaatacatgccgaaacacttagggaggtcttccacgagcttagtgtttgtggtatcgtatgaacacttgacgaggtcataacgagtctagtgagaatacatgccgaaacacttagggaggtcttccacgagcttagtgtttgtggtatactttgagacagacaaaccatacaaaagccggggactggcccggggagaaacggccgcatttggccgcagggagagtggagacaagaatatgagaatatatgtgaggcggattctgacggttgccgcggcggctgtgctgatggccgggcaggcctgtacggccctggcctacggaccgggagactattactacaggggaggtcccggcgtggacccgtattataatgaaaacgcttattacagcggaggcccgggtgtgggagaggggaacgccaaggagacatcgggcgacacgatctacgcctatccgggctggaacaccaatgtgccggacaccacccagtacacctacgatccctgggaatggtgggatgacgacgatgaggactgggatgacgacgactggtggtactataacaatgggccggaaggcgtttatggccagggatggcgctacagccccggtggctggtggttccagctctacggcggcagctggctgtccgacggctggaagatgatccgcaaccgctggtaccgttttgacggcagcggctacatggtgacggggtggttcacggacggggacggaaaccgctattacttaaacccggtggacgacggcacgctgggcatgatgcgcaccggatggcaggtgatcgacggtaaatcctattacttcaacacccagtctgacggcaccatgggccgcctctacgtggataccgtcacgccggacggctaccgggtgggggcggacggcgcgatgatacagtgacggatgatccggcctcaaactggatcgcgaaacggctatatttcaggggggaacatcatgatcgaacagctgttaaggcggattgtggaggagatcgcgccctgtccctttgtggcgggcatcgttctgggcgggtctcgggccacagggacggctacggaagattcggacatcgacatcgggatttattacgacagggaacggatggattttgaacgtttgaacgggatcgcctccgggttggatgaccagcaccgggaaaacctggtctgccgcgagggagagtggggaaactgggtgaactgtggaggctggctgaccgttaagggatatcatgtggacctgattctgcgggatatcgccagggtgcgggacattctggaccggaccgaacgtggggagacggcggcccattaccagaccggccatccccacggctacattgacgccatgtaccggggcgagctggcggccgggaaggccctctacgccagggatcaaagctttacggagatgaaggagcgggcggaggtttacccggaagaactgcggcgggctttgagctcattttttatgtttgaggctaaattttcctgtatgctggccgaaggcaacggcaggggggaggatctctactatgtggcggggcacctgttccgctcggtctcggccctgaaccaggtgctgttcgccttaaaccggacctactgcctgaatgagaagaaagcggtgcggcgcatccgggagtttccggtgacgcttccagattacgaccggcgggtgaacgggatcttcggcctgacggccgggacgctggcgccctgtatacaggcgctcaggaagctctgcggggaggcggaggagctggttgatcgggaaatgcgtccggcaggcgataaaaatccttaaaacacagaaaccggaagcccgtggcgctgacggcggttttttacacgcaaaaaatgcagacaaggcccacacgccatgtctgcatttgcaatttgccgctctccgcccggcggacgccgattgggacgcgagttgcgcatcccgcccggacgccgccggagggcagccccttttctcgggagtattttatgtcggcgcggctgcgccgtccgatcagagacgttttatccttcgcaccttcaaaacatccggccagtcccggcagccggggcggtgtgtgatggagtgtaatgcaatcaaggaatttcgtgtacttgattatgtttttatcgttgccccatccgccgtcgccggctggtgttgttttatccgttcattaggataatgcgcagggaggggattttattgcagaaactttaaaaatattcagggcttttcatggtaatttttggaggcagggctttgatgtaaggcgcgaggacccgattttgccagaattccagccggaatgtacgttgacgctcccgggcatctgtgctatttttgatatagcggcctacaccggcggcctggccgcctttaagacaatgaacggctgcggcgcggtatctgaccggcagaatgggcgggagggaatcaggatgaattttgaggagcgggttttgcgccatgaggaccagctgaacgagacggacgacgatattgtggcttatatccgcagccacaggcaggagatcatgaaactgtccatccagaagatcgcggcggatttatttatcgcgcccaacgcggtgatgcggctgtcgaaaaaactggagtacagcggcttttcggagctgaagttttcggtccagaacgaaggcgagccggagggcacgggaaagaccataagcggccgtattctgggacagctgccgtccaatatcgtgaaaacgctggacaccatcgatgtgctcaccctgaaaaaaacggcggctatgatgaagaaagcccgttgctgtatctttgcgggggtgggggactccacctatttctgcgagatgctgggcaagaatctcaggtgcctggactgcagcgtgcagttttaccagcagatacacgatatgttttacgcggtcaggcatggctgcagggacgatatgctgatcatcatcagcgccagaggggagaacgaccggctcatcgagatggccggggaggccaaagccatgggaatgccggtggtgagcatcactcatttttatgaaaatcgtctggcgaaggcctgcgacgtgaacctgtatttctggggcgaggaccgggaggtgcagggctacaacgttacggaccggagcgggctgatggtcctggtccggctgctcagcgaggagttctggcaggggtatgtggagctgtgaacctgcggctcggggagccggcacaggcgcatgggaggatggaacggtggaacagggaagcgggaaatggcctgcttcctttttgattgtgtaaatttacacagcaaaggcattttgtgtggataaattacgaaaaaacagcccagggctgattttgtgctatactcttatccaggttaaccgaaggatcaatgaccggatatccatccggcgtaaaaattgacgcatgaactgttacgacgaaaatgtgaaaggggtagactatgaatctgcaaaaagccacaagcagggaattaatcagtctggggtgtgaattttccaccaagctggaggcaatcaactatctggtggacaaactggacgccgcgggaaaactgtcctccagggaggaatattacaaggcggtgctggagcgcgaatctctctctgagacgggaatcgatatgggaatggcggtcccccacgggaagagcaaagcggtgcgggaagcggccttcgcggtggcgacggtcaagacccccatcaaaaactgggagagcattgtgccgggaaatgaagtgtccatcatcttcctgttagccatcccggagtcggaggcgaaaagcacccatctggaactgctgtcggaactgatgacccgcgtgtccaatcccgattatctggaacggctgaaagcctcaaagacgccggaagagctctactgtaacctggaagggggagcggctgaggcggaaaagagcagccggacatacgccaaaacgatcgtcgcagttaccgcgtgtcctgcgggaatcgcccacacctatatggcggcggaagcccttgtgaagggcggcgaggaactgggagtcaaggtctatgtggaaaaacagggcgcaaacggcgtggaggaccggcacacggctcaaatgctgcgggacgccgacgcggcggtatttgcggcggacgttgcggtgaaagacagcgagcgctttgaccatctgccggtgtacaagaccaaggtggccgcccccatcaaggacgccaagggcgtgatccgcggggcgctggagaaagccggacgggaaggcaagggtacctatgcgggagcagatgggggaaatgccgcagcgtcaggagataagaccagcgttggcagcgagatcaaacaggcggtgctcacgggcgtttcttatattatccccatcattgtggcgggcggaatgatcaacgcctttgcggtgctgatcgcccagggctttgggcttcaggagctttacaacatggacaacagctggctgtggctcttccggaagatgggcggaaataccctgggaaccctgatgattcccatgctggcggcctacatggcctactctctgggagataagacggccctggcaccgggatttgcggccggtatcgcggccaacctgattaacggcggattcctgtgcggtatgctgggcggtcttgtggccggatattccgtacggtttttgagaaaggcagtgcccgccaaaggagtgtttgcgggttttgtatccttctgggtgtatcccgtgttcagcacgctgatcgtgggaattgtgatgtttttcctgctgggaaaaccggtggcgtggctgaatcagagcctgatcggcttgctcagcgccatgagcggctccaacgcggcgcttttgggcgcgatcatcggaattatggtatcctttgacctgggcggtccggtcaacaaagccgcatataccttctgcgttggcgcaatggcggagggaattctcatgccctacgcggcctttgcctccatcaagatggtgtcggcgtttgcggtgaccatgtccaccctgggcttcaggaaatattttacaaaagaggagcaggaggcgggtatgtccacctggattctggggctggccggaatcaccgagggagcgatccccgtgatgatggcggacccggtgcgcgtgatcttctctctctgcgcgggttccgctgtcaccggcgccatcgtggccatgtgcaacatcggcctggatgttccgggggcgggaatcttttccatgttcctgttaaaggacggcatgggaggtctgggaaatgcattgatctggttttttgcggccgtgctgggcgcggtgatctcaaccgtaatcctggttgcccttaaaaagatgaaatacgacaagtcaatgagaaaataagaacgccgcaggcgtatggagtagattatggcagataaagtacatgttgtcccgcattttcactgggacagggagtggtattttaccgcagaggaatcaaaaatccttttggtgaacgatatggaagaggtactcaccatgctggagacacgggaggactacccctactttgtcctggacggacagacctcggtgctggaggattatttctccgtgtccccggaaaaccgggagcgggtcagggagctggtgcagaggggaaaactgatcatcggaccctggtatacccagacagacgagatggtggtggggggagagtccatcgtccgcaatcttctgtacgggatgaaggactgccgggagttcggcagtcccatgatgatcggctatcttccggattcctttggccagagcgccaggatgccgcagattttaaggggatttaatatagaaaacagtatgttctggcggggaacctctgagcgcatgggaacggataagacggaattcttctgggaggacgacgacggctcccgggtggcggtgcagctgctgcccctgggttacgccatcggaaaatatctgccggtggaaaaggaagccctgagaaagcggatggaaaaatacatgcccgttcttgagcggggaaccgccacaggccatcttttagtacccaacggccatgatcagatgccgctgcaaaacgatattttccaggtaatggaaacgatgcgggagttgtacccggacaagcagtttttcctgagccggtatgaggacgtgttcgcagccatcggccgccaggggaacctggataccctgcggggagaattcctggacggccggtatatgcgggtgcaccggagcattttctcctcccgtgccgacttgaaggcggcgaacacgcggattgagaacaaggtcaccaacctgttggaacctctggcctccatcgcctataaactgggattcccgtatcaccacggcctgttggaagccatctggaaggagctgatgaagaatcatgcccacgactccatcggctgctgctgcagcgataaggtacaccgcgccatcgcggaccgctatttcctggcggaggagcgcgcggaccggctgattgagttctacatgagaaagattgtggacgccatggactgcagccgggccctggataagctgacggtgttcaacctgctgccctatgagcgggaggggatgatccggggcaaaattgtcaccaagatgaagcggtttgcgctggagcgtgccgacggctcccggttgaaatacgagatcacggaccgcaggattgtggacgcgggactgattgaccggcagatcgtccactacggggattacgagccctttgtggagtacacgttggaattttgtgaccggattcccgccatgggatttaccacctatctggtcagggaagcggaggcgcttgctggggaaagccctgccgtgtccatggcggctggtacgggggaaaaccctgccgtggaaccggcggaccttggcggaaactgctgtcttgcctctccggccgccaataccctggaaaatgagtacctgtccgtgacggtcgaacccaacggcagcctgaccgtgctggacaaacagaaaggccaatgctaccgggacgtgctgctcttggaggatgggagcgacgacggagacggctacgactattcccccgcagcaaacgactgggtgttgacctcaaaggaggagactgcggatatccgctgccaacacgggacgtacagccacaaggcccgggtccgggtgtccatggctgttccggccggacttgagagccggagcgagcggcggagagacggccgggtggatgtggaatttgagctggagttaaaagccggatccccggttctggaggttcgggtgacggtggacaaccaggcggacagccaccggctgcggctgttggtgccgggacaggaaaatgaaggtttttccgtcagcgataaccagtttggccggatccgccgcccggtgagggacgaggccatggacgtgtgggagaaggagggatggtccgagcggccggattccatttatcctttcctgtcctgggtgtcaggctgcggggagcgtgggctggcggttctgaccaactcggtgagggagtatgagatgaccgggccggattacggcgtgctggccgtcacgttattccgaagcgtgggcgtgctgggcaaggaaggacttctcagaaggccgggcaggccctccgggattaagatggaaactccggattcccagcttcggggccgccgcacctacgagatcgcccttaccgcctgccgggatcatctggcgagaaccgcaaaggagtacgtcaccccgttcatttcctacaacaagatgccctacaacgccatgaagctgaatccgtctgaggtgaaggttccctatgcgttcagccttttgagcgagacggagggccgggttgttttgagcgcgttaaaaaaagcagaggacgaggataagctgatcgcccggttttacaacggctgcggggagaaagccccgatgaggctgaaggacggaaacggagacctgaccgtggacgtggtgaagctgaatgagacggatgtgctgagcgggcatgtgacgggagatcagtgggtgggttataatcagattgttacttgtaaattttaggaactgttacgaaatgtaaataaaacggtcagatactgagcgcgacagagggcagccacaccggccggtgtgtccgccctctgtttgttcgtgcgcctggcggcgcacgctgcacggcaaaccttcccataacgggcggccaccgcaggcgatccccttcttttcccgcagtaaacgccatattttcagcttttttcgccttttgcttcccgcgcttattgccagtgcccggattctgtgataatatataggttgctttttcagaaaggataccgaagactatgatacaatatctgatcgtatgcccgctgacttttttggccgggctggtggattccattgccggcggcggtgggattatctcgctgcccgcgtatctgctggccggagttcccgcccacaccgccctgggcaccaacaagcttggctcgtccatgggcacggtggtctccaccgtccgctatgcgaaaaacggctacctgaagggcaaggcggccatggcggcctgctccgcggtcgcggccatcatcggctcctccatcggcgcccgtctggcgctgatggtcccggacaatgtgatccggaacatgatgctggtggttctgcccattgttgcagcatacgttctgttcgataagcgcatgggggacagcgagaagaccggggatatttcccggcagcgcatgtttgtgctcagcgtgctggcggccctgctggtaggcggttacgacggcttttacgggccgggtacgggtacgtttctgctgctggtgctcaccggggtggcccggatggatgtgcgcagcgcctcggcccagaccaaggtgatcaacctgtcctccaacaccgcagcgctggtcaccttcattttcagcggcaacgtgctgtacccactggggctggcggccggaatctgctgcatcggcggccactacatcggctccggcctggtggtccacgacggacacaagatcgtgcgcccggtggtgcttgtggtgctgatcgcgttgttcgtgaaggtgctgagcggacggtaagcgtttccggccagaccgtcccggtccgccggctcccggccgtttcgtaaataagagaattaacagacaggagaagatagattatgaaatggaaaaaatttacacttaccaccaccacccaggcggtggatctggtcagcagcatgctggacgacatcggcatcgagggcgtggagattgaggacaacgttccgctcacggagcgggagaccaagggaatgttcatcgacattctgccggagctgccgccggacgagggcgtggcaaaggtgagcttctacgtggacgacgaccgcgacattgaggagctgatgaaacaggtggaggaaggcctggacgagctggccgtgttcacggatctgggacagcgcgccatctctgcctccgagaccgaggacaaggactggatcaacaactggaagcagtattttaagcccttcaccgtggacgacattctgatcaagcccacctgggagaccattccggaggagcacagggacaagctgctggtgcagatcgatcccggcaccgcctttggaaccgggatgcacgagactacccagctgtgcatccgccagctgaaaaaagccgtggacagcgggacaaagcttctggacgtgggcacgggcagcggcatcctgggtattaccgccctgaagctgggcgcgaaggaggtctggggcacggatctggacgagaacgccattacggcagtgggcgagaacctggaagccaacggcatttccggcgagcgcttccacgtgctgcagggaaatatcctgaatgaccccagcgtccaggagtgggccggattcggctgctacgacgtggtggtggccaacattctggcggatgtgatcattctgctggtggatgagattccggtgcatttgaagcagggaggactcttcatcacctccggcattatcaatatgaaggaacaggcggttctggacgcatttgcgaagaatcccgcctttgaggtgctggaggtaacccgccagggcgagtgggtgtccgtgaccgcgcgcaagcggtagagagggtttgccatgcatcatttctttgtggagcaggagcagatccgggacgggcaggtgcgcatcaccgggccggacgtgaaccatatgaaaaatgtgctgcgcatgcgccccggggaagagtttctggtcagcggcggcggaaacgacctgctgtgcgccgtggagagcctggacgtccagtccgtcagcgcgcggattctcggggaacagccgtccagagagctgcccgccggaatctggctcttccaggggctgcccaagagcgacaagatggaactgattatccagaaagccgtggagctgggggccgcgggaatcatacccgtagccacgaaaaacgccgtggtcaagctggacgcgaaaaaagaggagagccgcctccgccgctggcaggccatcgccgagagtgcggccaagcagagcaagcgcagcctggtgccggaaatcggccgcgtgctgtcctttaaggaggcggtggcccgtatggaccgggacggctttgaccttcgcctgcttccctacgaaaatgaacggggcatggaagccacccgggaagcctttgcccgcgtcggggaggcgaaacggatcgccgtgttcatcggcccggaaggcgggtttgacgagaacgaggtaaaccttgccaggtcggcggatatcctgccggtgagcctgggaaaacggattctcagaaccgagacggcggggctggccgtgcttgcggcgctgatgctgcgcctggaaggcggaatctgagcgcggggaaccggcgcggaggaaatgtgtccggcgcgtgtacccggcgcgcagccccgcccgtgccgcgcatgttttatataagaggagcaagtgaaaaatggaagcatattttgacaattccgccaccacccgggtctttgacagcgtgaaggacattgtggtgaaggcgatgacagaggattacggcaatccctccgccaagcaccgcaagggtatggaggcggagcagtacgtgcgccaggccgcggccagggtggcaaagaccctgaaggtgaaagagaaggagattctgttcacctccggcggcacggagagcaacaacatggccttaatcggcacggccatggccaaccaccgggccgggaagcacattatcagcacccggatcgagcacgccagcgtgtacaatcccctggcatttctggaggaacagggctttgaggtgacctacctgtccgtggacggccacggccacatttccctggaggagctggaggcggccatccggccggacaccattctggtctccatcatgtacgtgaacaatgagatcggcgcggtggagccggtggaggacatcggcgccctgatccgcaggaagaaccctgccaccctgtttcacgtggatgccatccaggcctatggaaagttcgtgatccgccccaaaaaggccatgatcgacctgctctccgtcagcgcccacaagattcacggccccaagggcgtgggttttctctacatcgacgagcgggtgaagatccgccccctggtctacggcggcggccagcagcgcgacctgcgctccggcacggaaaatgtacccggcatcgccggtctgggcgttgcggcggaagaaatgtacaccggccaccaggaaaagatggagcacatcacgtccctgaaggaccacatgatcgaccgcatggccgggcttgagggcgtgaccgtcaacagtcttaaagggaatttaagcgcccctcaggtggtcagcgcaagctttgcgggagtgcgcagcgaggtactgctccacgccctggaggacaagggaatctacgtctcctccggctccgcctgttcctccaaccacccggccatcagcggaaccctgaaggcggtgggcgtgaaacaggacctgctggactccactctgcgcttcagcttcggcgtgttcaacacccgggaggaagtggattactgtatcgatacgttaaaggagctgctgccggtgctgcgccgttactcgcggcggtagacagacgggcgcggccccgggaccccaacgcggccctggcacgaccccaacgcggccccggcgcaaccccaacgcggcccggcgcagctagaacgccgccctggcgcgccttacatcagcgcacaacctgcatccggcccctatggccggaattgctcagcatatagaaagaggttattatgaaataccagtcatttttgatcaaatacgcggagatcggcaccaaaggcaagaaccgtttcatgttcgaggacgccctgatcaagcagatccgttacgccttaaagtccgtggagggccggttcgaggtgaccaaggagtccggccgcatctacgtgatggcggagggcgactatgattacgacgacgtgatcgaggcgttaaagcgggtgttcggaattgccgacatctgccccatggttcagatcgaggacaaggattatgagaatctgaaaaaacgtgtggtggagtacatggaccaggtgtacccggacaagcacatcaccttcaaggttaacgcccgccggggtgacaagaattaccccgtcagctccgatcagatcaaccgggacctgggcgaggtgattctggaagccttcccggaaatgaaagtggacgtgcacaatcccgacgtgatcctgcgggtggaggtgcgccagaaggtgaacctgttctccctggtgatccccggccccggcggcatgcccgtaggcaccaacggcagggctatgctgctcttgtccggcggcatcgacagcccggtggcgggttatatgatcgccaagcggggcgtgaagatcgacgccgtctatttccatgcgccgccctacaccagcgaccgggccaagcagaaggtggtggacctggccaacctggtggcccgttacgcaggccccatcaatttgtacgtggtgaatttcacggacatccagctctacatctatgacaagtgcccccacgaggagctgaccatcatcatgcgccgttacatgatgcgcatcgccgaggccattgccaaccagaccggggccatcagcctgatcacgggggagagcatcggccaggtggcttcccagaccgtacagtccttagccgccaccaacgaagtctgcaccatgccggtattccggccggtgatcggctttgacaagcaggagatcgtggacctgtccgagaagatcggcactttcgagacttccatccagcccttcgaggactgctgcaccattttcgtggcaaagcacccggtaaccaagccaaatctcaacgtgatccgcggctccgagacccatttgcaggagaagatcggggaaatggttcaggccgctatcgatacggcggagcggatcacctgccagggctaaaccgggtcggcggcctattgcattctgcattcaacaaacaacaaaaaagctgcccccgcgaagcggtgggcagccgtcatgtacagcgttaaaccggtatgtgaattatgcgatgatgtagggagccagaatgtttaaaatctcgtcgatgttggcctctgcgtggatgttcaagtcgatgggcttggacagatccaggctgaagatgcccatgatggactttgcatcgataacatatctgccggataccagatcaaaatctacatcaaacttggataaatcgtttacaaaggatttaaccttgtcgatggaatttaacgaaatacgaactgttttcatacggggaaccctccttgtggtatatactttaagtgttggttgacaggaaatatggcctatccctatcctgcctttaatagtacagatgcgggccttaaaagtcaatagttagattgcatgaaaaaaaacgtaagaaactggtaatttatgattagcaaaaacaggaggttttgacatgcccaaggcggctcttcacaaccttggatgcaaggtaaatgcatacgaaaccgaggccatgcagcagcagctggaagcccgcggttatgagatcgtcccctttgaccaaaaggcggacgtatatattatcaacacctgctccgtgaccaatatcgcggaccgcaaatcccgccagatgctgcaccgggccaagaaaatgaacccggattccgttgtggtggcagcgggctgctacgtgcaggtggccgccgacgcgctgaaagaggacgccgcggtggatatcatagtgggaaataaccagaaggcacgcttggcggacattctggatgaatttttcagcggtggcagggaggacgtgtcctatgtggtcgacatctcccacaccaatgagtacgaagccctgcatgtggaccggatcgcggaccggaccagggcgtttatcaaggtgcaggacggctgcaaccagttttgcagctactgcatcatcccctacgccagaggacgggtgcgctcccgcagaccggaagaggtgctggaagaggtccgtgccctggccgctcagggttataaggaaatggtgctcacaggcatccatttaagctcctacggactggactttgagaatccggagagcgctcttacagccggggattacaaggccgaggagaatgccctgtaccgcccgtggctgctgaggctgatccaggaggtgagcggggtggagggcatcgggcgaatccgcttaggttccctggagccgcgtatcattacccgggaatttgcggcggagctggcgaagattcccaagctctgcccccatttccacctgtccctccagagcggctgcgacgccaccttaaaacggatgaaccgccattataacacggaggaataccgggagcgctgcggaattttgcgggaggcctttgacaatcccgccatcaccaccgatgtgatcgtcggttttccgggcgagacggaggaggaatttgcggcgacgcggcaatacctggaacaggtgcatttttatgagatgcatgtgtttaaatactccaggcgcgagggcacccgggcggccgtgatgccggatcaggtgccggagccggtgaaggcggagcgcagcgacaagctgctggagctggagaaacgcatgtccagggaataccgtcagggctttgtgggcaccgtccaggagattctgttagaggaaccggctgaaatcggcggcatcccctgcgtggtagggcacacgcgccagtatgtgagagccgccgtgccggcaccggttgccggaaatacagtgaaatccgccgccctgtctgcgggcgccggaaacacgccggacgtcgccgttctccagggcctcactgagggcctcaccgccccggtcaggggccggatcgtgaaggcgaggatcacaggcttcctggacgaggagacgctgttagcggagctgatcggggagccggggtgagaacagcggggcggggccggactgccggcccgtcccggtcaatcttcgatagtttcttccctttaagtggataaattttgaacatttcccgggaaatggcaggggattgtgctatattttacaaaaagtccaataataacagtcaaaattaagaaaataatctattgccgaatggacaattatcggttagaatagaaaagaatacttaaaggacgtgatgacatgggcaatatgatggatacacaatattttcaagctgttcaggacaacaagatcgaggtcagtgatgtgctggaacaggtttatgttgccttgaccgagaaagggtataacccgatcaaccagatcgtgggttatatcatgtctggggacccgacctatattaccagccataagggcgccagaagtctcatcatgaaagtcgagcgggatgagattctggaggaactgatggctgtgtacattgacgcccgcctgaagtaggagggcgcatttgcgtttcgtgaaccggagcggcccgcggggcggctccctgtgataatgaccgatcaacctgctggcgtctgactgcgtggatacggaatgaaatgcagacagaggctggttttgtcatgcctgagcatatacggcgggcgaaacaggccgttctgcgcgcaggcgcggcggcggtgacggcaagggaaacgcggcaaaatactgttcggaggcattttacatgagaataatggggctggattacggctcgaagacagtgggggttgcagtgtgcgatcctttaggtatcactgcccagacagtggaaaccattgtgcgcaaagatgagaacaaactgagaaagacattggcgagaattgaagaattaatcggcgcatacgagattgaacgcattgtacttggttatcctaagaatatgaacaacaccgtgggagagcgcgcgcagaaggcagaagagctgaaagcggcgctggaacggcgcaccggactgcctgtgattctctgggatgagcggctgacaacggtggcggctgaccgcgtgctgatggagagcggcgtgcgccgcgaacaccggaaagagagcgtggaccagattgcggcggccatgattctgcagggatacctggacaatttaagttttcagggagaacgggatgaaacaggagaacgagaataaagacaagattgtaatgattacagattcaggcgaatctgtggatttttatgtgctggaagagaccaggatcaacgcgtcgggctatctgctggtgacggacgcccccgagggcgaggacggagagtgctacattttaaaagatgtatccggacaacaggacgccgaagccatctacgagttcgtggagaacgaagatgagctggacggtgtatttcgcgtattcgaacagctgctggcggatgcggacgtgacgcttgagaaataggccatatgccaacacggatatcaatgaatggaggaatcaatttggaattagagaatcagaacacaacagaggcgaaagagaacacgcagccggcgaatcaggcggccgagcagggagcggaagcgcgtcccacagagggaacttccaccaggcgcaggcgcaaaccgtcgtcctcgcgttccggcaagagccgcgatggacaggccaagacggctcaggtaggggacggacaggccgagggcaagaaggcccaggcaggggacggacaggctgagggcaagaaggcccaggcggccagaaaagagccggctaagaaggaagccgcgaaaaaagaaccggctaagaaggaagcggccaagaaagacgcgggcaagcgggagaacgcttccaagcgcgaaccgggccgtgagacgagaccggccgcaaagcctcagaaccagaatcagaaccgccccgccaaggcgaaatccgctcccaagggagacggcaagggtaagttgaaaatcattcccctgggcggtctggagcagatcggaatgaacatcaccgcctttgagtacgaggacaccatcattgtggtggactgcggactggcgttcccgggcgacgacatgctgggaatcgatttggtgatcccggacgtcacctatctgaaaaataacatcgacaaagtaaagggctttgtgatcactcacggacatgaggaccacatcggcgcccttccctatatattggaacagatcaacgtgccggtttacggcaccaagctgaccatggccctgatcgaacacaagctgaaagagcggggcatgatgcgcaacaccaagcgcaaggtggtaaagcacggacagtccgtgaacctgggatgtttccgggtggagtacatcaagaccaaccacagcatccaggacgcggcggcgttagccatctacaccccggtgggcacggtgctccacacgggcgacttcaagatcgattacaccccggtgtttggagatcccatcgacctgcagcgctttgcggagctgggcaaaaagggcgtgctggcgctgatggcggacagtaccaatgccatccgtcccggatttaccatgtccgagcgcacagtgggcaagacctttgacgccattttcgcggagcacaagaataaccggatcattgtggcgaccttcgcctctaacgtggaccgcgtgcagcagatcgtgaacacggcgcacaaatacggccgcaaggtggtcgtggagggccgcagtatggtcacggtgatggagattgccagggagctggactacatcaatgtgccggagggaacgctgatcgacatcgagcagctgagaaattatcccccggagtccacggtgatcatttccaccggaagccagggcgagtccatggcggctctgtcccgcatggcggcatcgcttcacaagaaggtcaccatcacgccctccgatgtggtggtgcttagctccaccccgatccccggaaatgaaaaggccgtggccaacgtggtcaacgagctgtccatgaggggcgctacggtgatcaatcaggacacccatgtttcgggacatgcctgccaggaggatttgaaactgatctactccctggtacatcccaagtacgcgattccgatccacggcgagcatcgccaccgcatggctcagaaggagctggcccagtttatgggcgtggagaaggacaacgcggtgatcatcaattccggcgacgtgctggccctctccgaggacacctgcgaggtcatcgaccacgtagctgcgggcggcatctttgtggacggcctgggcgttggcgatgtgggcaacattgtgctgcgcgaccgccagaacctggcccagaacggcatcattgtggtggtgctgaccctggagaagcgcagcaaccagcttttggccggtccggacatcgtatcccgcggctttgtgtacgtgcgggaatccgaggacctgctggaggaggcgcactccgtggtggtggacgcggtgaacgactgcctgaaccgccatgtcagcgactggggtaagattaagaacgtgatcaaagacagcctcagcgatttcctgtggaagcgtatgaagcgcagccccatgattttacccattattatggaagtgtaatgactgatcaggaccgcgcgtccgcttgggcgggcgcagattcctttgccgaaggcgggatgtaacaaaatcacaacaggaggaaacaggacatgagcaacgcgaccagagagatcaaccgaataacgaccgcaatcatccgcatatcgatgaagcttatcgtctatgccctgatcatcctgcttctctacgaggctgtcatcaaaggatacgcctttggacatcagatcttttacgcggaggctatggaggaggcgccgggtcacgacatgaccgtgaccattgaaccggacacctccgtgagcgaggccgcgcagatgctggcggacgacgggcttatcaacagtgagtttgcgtttattttccagagcatgttttacgactatgatgcgatttatccgggcgtgtatgatttaaatacctccatgacctccaaggaaatccttcaggcgctcaacgtaaagcctgaaaccgaggagacggaagccgcgcagaaggcgggagcccggttgaaaaccacccaggatcaggcggctccggcgagcgcagaagcggatggacaggcagcgccggctgccagggcggctggcgcgggcgaatccgcggcggccggtggagcggcggaaaatggggccggcgcagatgtgccggctgccgcgtccgcagggcaggaaggccagcccgcagcggacggccaggaggctcagagcgcggcggattccggggccgaagccggggatgacacctttgacgacgaggaaggcgaggtcggcggttggattcaggatgttgaaggagcgggccaatgatcgcagacagcagaattacagactatatactatcactggaaaccggccagggccaactgtgcgaccgcatcgaacaggaagccctggccgctcgggttcccatcatccgcagggagaccgcggcgctgctcaaaaccctggtggcggccaaagccccccgggcgatcctggagatcggcacggcggtggggtactctgccctgctgatggcccgggtgatgccggcggactgccggattacgaccatcgaaaaatatgagaaacggattcccgttgccagggagaatttccgcctggccggggaggaggagcgcatcaccctgctggagggggatgcggacgagattctggaccgattgaagggaagttattttgacttcgtgttcatggatgcggctaagggccagtatctggcctggcttcccaagctgatggagcttatgcccgcgggcgcggttttagtttccgacaacgtgctccaggacggggatatcgtccagtcccgctttgcggtggagcgccgcaaccggaccatccacgcccggatgcgggaatacctctatgaattaaagcacaacagcgcgctggagacgtccatccttcccgtgggggacggggtggcgctgagcgtgcgcagatgatgaacgcaggcagcgcatctgccggtagagacatgaaaagccgcaggcgacgcggcggaatggagatttcaggatgagaaagacggaactgctgattccggcgggcagtctggacgtgttaaagaccgctgtagtctacggcgcggacgctgtctatatcggaggagaggcattcggcctgcgggccaaggcgcacaatttttcgaaccaggagatgaaggaggggatcgagtttgcccatgagcggggcgtgaaggtctatgtcaccgccaatatcctggcccacaacggcgatctgcccggggtggaggaatactttgaggagctgcaggacatcggacccgatgcgctgatcatatccgatcccggagtatttgccattgcgaaacggatactgccgcagatggaacttcacatcagcacccaggccaacaacaccaattatggtacataccagttctggtatgggctgggagccaggcgtgtggtttccgccagagagttgtccctgaaggagatccgggagattcgggaccacattccggaggacatggagatcgagagctttattcacggcgccatgtgcatttcctactccgggcgctgcctgctcagtaactattttacgggccgggacgccaaccagggggcctgcacccatccctgccgctggaagtacgcggtggtggaggagacgcggccgggcgagtacatgccaatttatgaaaatgaacggggcaccttcatcttcaactccggggacttatgcatgatcgagcacatcccggagatgctggaagcgggaatcgacagcttcaagatcgaggggcggatgaaaacagcgctctacgttgctacggtgacccgcacctaccgcaaggccatcgacgactgcctgcgcgacccggagctttaccgaaggaacatggagtggtaccgtgaggagatcggaaagtgcaccttccgatcctacaccacaggcttttatttcggcaagcccggggcggagtcccagatttacgacaacagcacgtatatcaagaattatacctacctgggcaccgtggaggagacggacggtgcgggccggggccgcctgatccagaaaaacaagttctccgtaggcgagaccatcgagatcatgaagccggacgggcgcaaccttgaggccgtggtccgggagatccgcagcgaggacggagaacttcaggagagcgctccccactccaagcaggtcctctgggtcggctttgaggcggaggcgggcgcagagccctacgatatcctgcgcaggcgggaagagcaggcgggggaataggcgctgccctggcaggattctcatagtcggaaccgacttgttgtggcagcggcagcgcccggtggaaaccggcgctgccctgtctgtttcaggactgttttcgggcggcgtttccgccatggaaagtattgccaagtccgcccgaatagtgtaaagtaacaggtacaggaggattgaccctatgatcgatgccgtcttaattggattagcggcgctctgcgccggatattttgccgtgatcgtgctctatgcggggatcggaacctcgtttgctttcatatggctgttcttcgcggccctgtgcctgtttctggtgtacggaaagtggtattaccggcgcaatgcggaccggattccccgctgggtgccggtttcggtggtgaccacctgcgtggccggtctgacggtgttcgcggcggtctgcatcatggtattttccggcgtggcgggttccgatcctgtggggttggattacgtgatcgtgctgggagctcagggcaaggagcacacggtgaacggctccctaaagctccgtctggacaaggccatcgagtatgtggaggagaacccggacaccatactggtgctctccggcgggcccatgcagggggaggagaaaagcgaagcggagctcatgtatgattatctgcgctacaacggcgtccggccggaccagatgctgatggagaagcgctctgccagcacggtggaaaacgtggcgttcagccgtctcgtcatcgagcaggaccgtttggccagaaagcggaaacgggaggcgctctttcagccggtgggaccgggcgtggagcctttggccccggataagcccctggagatcggcgtgctcaccagcaatttccacgtgttccgcgcccgcctgaccgccaggaaatggggcattgaaaatgtctccggcatcgcagccaaatcggacccggtgctgttcgtgcatctttgcgtccgggagtgcgcgtccatctttaaggaccggcttgtgggaaatatgtaaacaggcgtatattttttcgaaaagtttggattaataaggatgcgggactgcgcagcccggtggatacagaagacgcgcattgtggacagagtataagagaatggagagaattgtggatatgtcggatcgcagcaatctggaaaaattgaaagatcttacccagtatcgggtattaaaggaaacatacatcgaggaaatgaattcccagggagtgattctggagcacgtgaaaagcggcgccaggattttcctgatgtccaacgacgacgacaacaaggtgttttgcatcggatttcgcaccccgccggaggacagcaccggacttcctcacatcctggagcacagcgtgcttgagggatcggagaaatttccggtgaaggatccctttgtggagctggtgaaggggtctctgaacaccttcctgaacgccatgacctacccggacaagaccgtttatccggtagccagctgcaatgacaaggatttccggaacctgatggacgtgtatatggacggcgtgcttcacccgcggatttaccgggagcccaagatctttctgcaggagggctggcattatgagatggagtccccggaggacgacctgaccatcaacggcgtggtttacaatgagatgaagggcgccttctcctcgccggagagcgtgctggaccgctatacccgcgcggttctgttccctgacaacagctatgccaacgagtccggcggcgatcccgcctttataccggaactgacctatgagcagtttatccggttccaccagacgtattaccatccggccaacagctatatctacctctacggcgacatggatatggaggaaaatctgcggtggctggacgagcagtacctgagccgctacgaccgggaggattgcccggtggactcctccattccgctgcaaaagcccttcacggaaccggtgcagcgggagatcacctactccgtcacgccggaggaggggacggagaaaaagacctacctgtccgtcaacacggtggtgggcacggacctggatcccaagctctatgtggcgttccagattctggaatacgctttgatctcagccccggccgcgcccctcaagcaggcgctgatcgacgcggggctgggcgaagatattatgggaggttacgagagcggcattttacagccctatttctccgtgatcgccaagaacgccgacaaggagcagaaggcggagtttctgatcgcggtcaagggtacgctgcggcgtctggcggatcagggcatcgaccggaagagcctgttggccggtctcaattactacgagttccgttaccgggaggcggactacggttccgcgcccaaggggctgatgtacggcctatggtccatggacagctggctgtacgacggggatccgctcatgcacctggagtaccaggagacctttgacttcctgaagcaggcggtggatgagggctattttgagggcctgatccggcagtatctgctggacaatccccacgaggccgtgattctggtggcgccggagccgggcaagacggagcgggaggacgaacagctggccaacatgctggcggagcggaaggcttccatgacgcccgaggccatcgacgccgtggtacagggaaccagggagctgcgggagtaccaggaggagccgtcctcccaggaggatttggaaaagattcccatgctgggccgcgaggatatcagccggcaggggacgaagcttcagtacacggtgcgggaggaagccggggtgacggtgctccacactgatctgttcacctccggcatcggatatctgaagatccttttcaacacggaccgggtgccggtggaggatctgccctatgtgggacttttgaaggcggtgctgggttatgttgacacggaacagcacacctacggggatctgtccagcgagatctttttaaacagcggcggactggatttttccgtgacttcttttgtggatctggagaataggggacagtttaccggcgcttttgtggtaaacgccaaggtgctttatgaaaagctggattttgtgtttcacaccgtgacggagattctgacctgttccaagctggacaatgaaaagcggctgggcgagattctggacgaggttaagtccaggtccagaatgaggctggacgacagcgcccatgcggcggccgtctcccgggccagctcctacttctcccctacctccgcgtttaatgagatggttggaggaattggatattatcattttctggaggatgttgcgaaacgctacggtagcgagcctgggtaccgcaaggagttgatcgccaaactgaaggagaccatcacccgcctgtttaccgcggacaatctgctggtgggctacacggcggatccggaaggttacgccgtgctgcagcgggagctgggggccttcaaggccagtctgcccgcgggggagcaggcgcgctatccgttcgcctttgagccgggcaaccgcaacgagggctttatgaccgcctcccaggtcaactatgtggcccggtgcggaacctttgccggttccggctatgcttataccggagccttaaaggtcctgaaagtgatcatgaactatgagtatctctggtccaacctgcgggtgaagggcggagcttacggctgtatgagcagcgtgggcgcttccacggagggatatttcgtctcctaccgcgaccctaacctggcggggaccaacgcggtttacgaagggattcccgaatatctgcgcaatttctccatcgaggagcgggatatgaccaaatatgtgatcggaaccatcagcgatatcgatgcgcccatgtcgcccgccatccgtggaagccgcagcgtttccgcctatctctcccatgtgacggatgagatgatccagaaggagcgggaagaagttctggacgtgacccaggaggacatccgcggcctcgccggaatcatccaggctgtcctggacaccggagccctctgcgtggtcggaaacgggcagaagatacgggaggacgaggcgctgttcaaaaacatccaaaatctgtatcattgaatgtaatgggcctccgcgccttttgcggagggcgattgcggaatgtaatgggcctccgcgtcttttgcggagggcgattgcggaatgtaatgggcctccgcgcggggccaaccccacaaccttagatttgagatagaacgggcggccgccgctgttggcgcgccgcccgtaaaaaaggagagcactatggaagagaatgcacagaagaaatccggctttgtgaccctgatcggccgtcccaacgtgggaaaatcgaccctgatgaaccatctgatcgggcagaagatcgctatcacctcggacaagccgcagaccacgcgtaaccggattcagaccgtctatacggacgagcgcggacagatcattttcctggacacgccgggaatccacaaggcgaagaataagttaggagagtacatggtcaccgtggccgagcgcacgctgaccgaggtggatgtgatcctgtggctggtggagcccagcacctttatcggagccggggaacgccatatcgcggagcagttaaacaaggtgaaaaccccggtgatcctggtgatcaacaagatcgacaccgtgaaaaagcaggaggaaatcctgacctttatcgacgcctacaaggacgtctgccagtttgcggagatcgtgcccctgtccgccttaaaagaccggaacacggacctgttaaccgagctgatcttcaaatatcttccctatgggcctcagttttatgacgaggacatagtgacggaccagcccatgcgccagatcgcggcggagctgatccgggaaaaggccctgcgcctgctggacgacgagattccccacggaatcgcggtggtgattgagcagatgaaggagcgcaagaacggcatgatggacattgaagccagcatcgtctgcgaacgggagtcccataagggcattatcatcggcaagggcggcagcatgctcaagcgcatcggcatcgaggcccggaaagagatcgaggacatgatggagacccaggtgaatttgcagctgtgggtgaaggtccgcaaggagtggcgggacagtgaactgtacatgaagaactacggttataacggaaaagaaatttagaaaaaattggaatacgatttgatgagaaatgcgtctaaaatcgtcgattttgttgtttttacaacaaaaaatgcaaaaatacaacatatgatggctgggaaggccgggacatggaaagggggtggaagggatgcgcgaggcggttacattgaacggcatggtgctgctgtccgcgccttcaggagaatttgaccggcgtctggtgctgctgacaacaggcaggggaaagatcactgcctttgcccacggggccagaagaccgggcaatcccctgatggcctgcacccggacctttgtgttcggcaaatttacgctctatgagggccgcaccgcctacaatctccagtccgcccaagtggccaactattttgacgagctgtcctcggacatggagggcgcctgttacggctcctattttctggaactggcggatttttactcccaggagaacatggacgccacggaacagctgaagcttctgtaccagtccctgcgggcgctgttaaagcctgcgatccccaaccggctggtgcgccgtattttcgagctgaaaatgatggtgatcaacggggagtacacggaacagcctcccaacccagtctccgattcctgctcttatgcctgggagtacgtggtactgtctccggtggaggcgctgtatcgctttgcactgacggacgaggtgctgagggaatttgagcgcgtggtggagagcgggagaaggcgtttcctgcgccatgaatgccgttccctggagattctggaggttctgacttcggactagatacaccttaggaccaaaaggaccgaagttttaccggataaggcttgaaatattcagagtcagacgctataatattcccatatgtgccaaaaggaaggaaccgagtatgaaaaagataagcaggtatctgctgctggcagcggtggtaatggccgtgtttgccgcgtcgggctgcgccagaagcgacaagggcgcggtatttgatccggatcagagcagtattttcgtcaagaaggacggcagcgtgctcagcgcttccgtagaacatagcgatcagaactactattcggaggaagaactgaagagctttatggaaggcaggctgtccgaattcaacgcagcccagggaaaagagagcgccgcatataataaagaaggcgcagaaaagctccccgcggccattgtctcctgcaaggtggagggagcggacggagccaagacggtaaaatccatcgtggagtacagctctccggagatgctactggccctggccggtgagatccgggacggtgagatccagctggccgcccttgccacagacagcgtggaaaaccggctggccgcgggcgatctggtgggaagcacctttgtggacgccaagggaaacgccgtggaggtgggtaagatcaccagccagagcaagctgcgggtggtttcatcccagggaccggccctgatccaaaccgagggaaaggtgctgtacatgtccgatggctgcacgctggtggacgaatacacggtgcagacgccggaggaaggcagcagtttcattatttttaaataatatgaatggatagagagcgccggggcgtgcgggactttccacagtgcgggaagaatcagttttgccggtggagttgatccgacgggcgcgaggaaagagagaggacgaagcaatggaaaagacgatggaaaagattgtggcccttgccaaaaacagaggttttgtatacccgggttccgagatttacggcggccttgccaacacctgggattacggcaacctgggcgtggagctgaaaaacaacgtgaaaaaggcgtggtggcagaagttcgtgatggagagcccctacaacgtgggcgtggactgcgccatcctgatgaactcccagacctgggttgccagcggccatctgggcggattttccgatccgctgatggactgcaagcagtgtaaggagcgtttccgcgccgacaagctgatcgaggactacaacgccgagcacggcatcgagatggagggctccatcgacggctggtctcaggagcagatgaaacagtacatcgaggacaatcacatttgctgccccagctgcggcgcccatgatttcaccgatatccgccagttcaacctgatgttcaagacgttccagggtgtgaccgaggacgccaagaacaccgtttacctgcgccccgagaccgctcagggtattttcgtcaacttcaagaacgtgcagagaacctcccgcaagaaggtgcccttcggcatcggccagatcggtaaatccttccgcaacgagatcacgcccggcaactttaccttccgtaccagagagttcgaacagatggagctggagttcttctgtaagcccggcacggacctggagtggtttgcctactggaagcagttctgtatcgactggctgcgcacccttggtatcaaggaggacgagatgcgcgccagagaccattccccggaggagctgtgcttctacagcaaggctaccacggacctggagttcctgttcccctttggctggggcgagctctggggcatcgcggaccgtaccgactacgacctgacccagcaccagaacgtgtccggccaggatatgacctactttgacgacgagagcaaggagaaatacatcccctacgtgatcgaaccctccctgggcgcggaccgcgtgacgctggccttcctgtgcgccgcatacgacgaggaggagctggccgagggcgacgtccgcaccgtgctgcgcttccatccggccatcgcgcctgtgaagatcggcatcctgcccctttccaagaagctgaacgagggcgcggagaaggtgttcgccgagctgtccaagtattataactgcgagtttgacgaccgcggaaacatcggtaagcgctacagaagacaggacgagatcggcaccccgttctgtatcacctacgactttgattctgaggaagatcacgcggtaaccgttcgcgaccgcgacaccatggaccaggtgcgcgtgccgattgcagagctgagaacgtattttgcggataagtttatgttttaatatgtaaaacgggagacggtatggcgaaagctgtaccgtttttttgatgcaatggggattggaggcacaaaaaaaccggccgcaaaatgcagccggtttgcgcacttttattgcctgcgcgcggcccttccaatccgctgtcccatgcgcacccgggtttcctcgccgcgggcggaggcctggaggatgggctcgtccaattcaacggctcccggcatgaacagcagcacgatggtggagccgccgaaggcgaaatagcccttttcctgaccccgcatcacgtccaggcgtgtgtaaccggtgtgatgattcacaattttccccaccatcagagcgcccacttccatcatcagataggtgccgaaatgttgggagcggaccaccgtgtactcacggcagttttccttatagatggggaaatggtcgtttgccacgggattgacggtgtgaaggcggccggggatcttccggtaatgggcccgcaggccgccgtccggccaggcgtaccggtggtaatcatccacgcagagcctgaacaccaaagccgtgcccccggcgaaccggcgcgccaacttgggatcacgcagcaaatcctccagccggtaggcggtctgcttgatgtggaatacccgccgggggctgatggaataagcggtgagccgggcgtcacaagggctggctaacgtcagggggtccgggtcaaagggacgggcttggggcagcagccggcgggtgaacaggtcgttaaaggaacggtagcgcccgcccgcaggcagttcgcactgggataagtcgatgtgggcggtacggataaaggatggtatcagaattcgggatagggaggaatccatacaataaccaccgattttggatatcaccggatgggtgaacgggaggatcagagcgcggcccagagcgtgattgtagatgagctgcagcagtttgtcctggaagccgtcacgggggccggcatttgtggaagcattatgtttcatggcattggctcctttgatgttgatgatggatgcgcagagtaaaaaggtggtacataccgtcgaaaatacgcccataggttcggtacagaacaggtatccttcccagccgcaggcagacttccgccagaaccaccgcccccataatatcgatcaccacatgctgtttgaccgctagtgtggagatgaataccaggatggccatgacgcaggaacaacggcggtaccacagggggatagcggtattccggcggattccgatgtaacagaaccagctgaccaggcagtgaaccgacggaaacaggttcagcggcaggtccagtgcgtataaaatccgcatggcatgattccagaagccgggaccggagacatccggccggatgttagtggtcggaaatgccaggaaaaagatcaggcatacgatccgggagagaaagtccgcagtgaagaactggtaacacctggttttgtcctggcgggcgatgaggatgtagttgacgatccagaacagatagcagccaagatatacaaccagaaactgggggataaagggaagccggttatccagggggctggcgatgtcgtgccgcggcagatcgagagccagaagctgcgctccgccgtacactgtgaaattgactgccacagcgaagatcagcggaagtaccgcataacccggcagcagcctctttcgtttttgtccaatccaatccggcatatagccacctccaaaataaatacattatatcataggtttatgataaatggtacgtttcctcaattatattatgccattatattatgctgttaagcgggcggtttgtgattaggggggccttattatacaaggtcaccaaccgccaggttgctgacaagtgctacgtttccttattatacatggtcaccaaccgccaggttgctgacaagtattacgtttccttattatagcaaatatgtaggaagaaacaaggaagaaaggcggtttctttataaaatttagaatagttttataaacgcccatttacaaatgtggtatacttacaagtacgggtgaaagtctgtcccggactgtcaattttgtccggtgggctgagatactataaaaaaggaggcaggacctatgaaactgaagacccgtctggcggttgcatttttgaccatcaccatcgtgccgatcctgctgttttatgtagcggtagtagggctgagcagttatcagacccagtcctttcgcaaagaatacgggttgacggagcaggtggacctgttctccggcaactcccttcagatctttaaccgcctgaccaagcgttaccaggaggagatccggcagacgctgaaggacaatcccggactctacgaggacggcgcatatttaaacaatttgaacgaggagctgaaaagccactatgcgtatctgattgttcttaagggcggggaggtttcattctgcgggagcaatgacatgcagatggatcccgctttgtacgacaagctgcccgatttcgacgctatgaaaggcgatttggagggcggtatctatctggatggagagaatcagcacctgatcaaacagatggatttcacgttccccgacggtacgccgggaagcgtatttattgtgtcaaacgtgggcgatctggtgccggaggtcaaatccatgatccgggagatgctcttccttggaatcgtgattctggtggtggcggggattaccctgaccgtctgggtttacaggtccatcttgagccccctcaacaagcttcaggaagcgaccaagcagatcaaggcggggaatctggattttacgctggatgtggacgcggacgacgagatcggcgagctgtgcaacgattttgaggagatgcgcatgcgtctgagggagaacgccgaggagaaggtccagtacgacaaggagagcaaggagctgatcagcaatatttcccacgacttaaaaactcccatcacggccatcaagggctacgtggaagggatacaggacggcgtggcttcttcgccggaaaggctggacaaatacatccgcaccatatacaataaagctaatgacatggatcgtctgatcgacgagctgacgttttattcgaagatcgataccaacaagattccctacaccttcacaaagatcaatgtggcccagtatttcaaggactgcatcgaggaggtgggcctggatatggaggcccggggcattgagctgggatatttcaactatgtggacgaggatgtggtggtgattgccgacgcggagcagatgaagcgggtaatcaacaatattatcagcaactccattaaatatcttgacaagaaaaagggtattatcaatattcggataaaggacgtgggcgacttcatccaggtggagatcgaggacaatggaaaaggaattgcggccaaggacctgcccaatatatttgaccggttctaccgcacggactcctcgcgcaattcttctcagggcggcagcggcattggcctgtccattgtgcgcaagataattgaggaccatggaggccggatctgggcgaccagcaaggaaggcatcggcacagagatccattttgtgctaagaaaatatcaggaggtcatagcaggatgagcaaaatactgatcgtggaggacgaggagagcatcgcagagctggaaaaggactatctggagctttccggctttgaggtggaaattgagaataacggcagttcaggcctggagcgggcgctgaacgaggaatttgatctgtttattctggatctcatgctccccggcaccgacggttttgaaatctgtaaaaagatacgggaagtaaaaaatactcccattatcatggtgtccgccaagaaggaggacattgacaagatccgcggtctgggcctgggcgcggacgactacatcaccaagcccttcagtcccagcgagatggtggcccgggtgaaggcccatatggcccggtacgagcggctgatcggcagcggacagccgtccaatgagatcgtggaaatccgcggtttgaagatcgacaagacggcccgccgtgtgtgggtaaacggtgaggaaaagacgtttaccaccaaggaattcgacctcctatccttcctggcccagaaccccaaccatgtatttacaaaggaagagctgttttctaaaatctgggacatggagtccatcggcgacatcgccacggtgaccgtgcatattaaaaagatccgtgagaagattgagtttaacacggcgaagccgcagtatattgagacgatctggggcgtggggtaccggtttaaggtataatattgacatgatactcgatttggtgtaaaataatcttagctaggaagttaagtatgtccatttggacacaaagtgaaatcccgtgtatgccagtacacgggatttctttttggctagctgtctttatgatttcagtctagccatttgcagatatagtagccagctacgcctgccatgaccgggagaaggaagtcaaattgaatacagagtacaaaacccgtgtataggatgtgtgcgcgggttttcttttggaacggtttttctggcagcgtttgagccggaaggcggaccggctgcaaacattgggagcagagggggataaagtattgctttttttacccaaaatctgataatatagttctgttgtaaataatacgcaaaaggaaaataatcatgagaactgtaaataatagcagacggcttcagattgccaactatgttaaacagaaaggagaagcctcagtccaggaattgagcaaatattttgcagtatctccactgacggttcgcagggatttgacagcattggaggaacagaagctcatccagcggtaccacggcggggccaaggccttggcgcagttggatacggcgaacgacaacggcaattatgagtttgatctcacgcgcgtgccccgtggggaggaaaagaaacggatcggggacaaggcctgcgagtttcttaaaaatgacgacatcatttttatgaacagcggaagcacggtgttgttttttcaggaggcgatccgggataagcatgtcacggtggtgaccaacaatgccagggcccctttctgcagcaggcagccgggagtggagattctcagcctgggcggaaattatatggagcggtccaaatcctttgtgggcgagatcacggtgaataccataggcgggatctacagcaactgcacgatcctgggcgtaaaggccctggacccggagcggggaatgaccacctggaattaccaggagtgcggggtgaatgctgccatgatcggccataccagaggcaaggtgatccttctggccgaccactcaaagatcggcaaggtgtccaactatgtgtcctcctctctggataaaatcgacctgatcataacggacagtggatgcgacccggaagccatagccgcgttccgggagaagggcgtggaggttatcgtcgtttagagcggattttggatgtgcggaagccggataaaatgcgccgccggagcgcagaggatagaccggaacgaaaagaggggcgggaactatggatacggaagaaaaaaacgagtttgaaaacgagcttctttcgcgcatctcacagatggagcggggaaatgagcctgcgatcagacggatgaccggaacggattatatactggtgggggcgattgtcttgggatgtctggcagcggtagcggccggatattttctggcatagcgggagggccttaagcaggatgaaacgagtggaagagcaaattgccagggaggcggtgttcggaattttgccggtgctgcccggggaacgcagatacggttttttggacgcctttttggtgctgtccgggtattgcatcgccacctggagttacacgcagggggcttatcttgccggcctggtgggttttaaacaactgctcatcggggcgtttttcggagcagttctgatgttggcggtgtaccagctcccggtgattctttcggtgcgctacggaatcgatatctggatctggctgcggagcgtgttcggactgcggggagtgaagtggatatccgtgctgatcatcgccatcaattttccgtggtacgcggtctgctgcgatctgttcgcctcctccatggagaatctggcgggagtgtacgggctggcgctgccgccgggcagtcatctgctgctggaattggcctgtctgctggccggaacctttatcgcctgccgcggaatcgggacgatcacctggaccacgcggattctggtgcctgcccttttggccgtgggggcgattgtgatggtgattggttttcgctctgttccgccggaggtgatctggaattatacgcctgaaccgggggcatacgcggaccgggccgttccttacattatgtccattgaggcgaatttcgcttttgtcattacgctggtgggcgggatggcgggagtgccaaggcttgcgaggaccgagcggggcggctatctggccggcgttctgggacagggcctgtccggttcgttttttgtggtggtgggcgcggttatggccatcgcgatgcggcatgtgaccggaaccatgtccgaggatccaacgcggatgctggcggtcctggcgggtccggctctggccctttgttccctgctgctggtggcattcgccaatatcggcacccaggcggtcggatcgtacatatacggtgtgatgctcaaatcgtccttcccggagactgactaccgcaggctgatcggaattctggccttttacgtgggcgcgctgtgcgtatggggaaagatcgtggagtattttggggcgtttctgaccatcagcgcctgtgtgtacgcgccgttggctgcgctgttgtttgtggatttcttcttcgtgcggcaacagaggctggcttttcgcagcgcttacgggctgaagggccatgaggcgtatgtgtacaccaggggatttaaccttgtgggcctggctgctctggctgcgggtacggctttttccctgatgatctataatccggtaacgggtgttatccacaatcggcttttatttacgctgacgcctaccgggtgttccttcctggcttccggctgtatttactggctgctctgcaatctgccgggaatccggcgctacgtgcgccgggatttggcggaggttccggacacaagaccctttgaccgctttcgggaaccgccgcggcagaatctggcggccatgccgtttatctggctgtggtgctgcctggtgactgccagagcggggcttaaaatacgcaaaaaaggtatgaaagggctgaaaccgccgtttctggtgctggcgactcaccactcgtttacggatttttatgtgacgccgcgggtgctgtttccccatcgggccaactatgtgtcggagctggaaggatttgagaactttggagagtggctgtaccggcagtcaggctgcctgggcacccggaaatttgtggacgacctggcgctggtgaaaaatatctgccgggttcttgggcgcggcggtatcctggtactgtacccggaagcccggtacgccaacgtggggaccagttccaggctgcctttggcggtggcaaagctggtcaagctgtgtaaggtgccggtggtgactctgaacatgaaggggaattatttacagtctcctatctggaatctgcggattcgccgggaagtcaggctggaggctgaggcggagctggcgtatacggcggaggaagtggaacgcgctcaggtggaggatatttaccaaacattatcacggcttctgacttacgacgaatacgcctggcagcgcgcaaccggactgcggatcacagattccttccgggcggagggccttcatttgccgctgtaccagtgccgggcctgcggcgcggtttaccggatggcgtcaaagggcagcgagttgttttgcgcagcctgcggcgccagatggcggatggacgagttcgggacgctgaggcggaccgatccggcgtcgccggctgtgagcggaagatgcgcccccgggccggaactctacattcccgactggtacgagtggcagcgggagaatgtgcgcagacggattgcggccgggcggtatttcctggagctttgggtgcgggtggaggcgctgcccaacgcggtgaactttatcgactgcggcgcgggacggctggagcatgggccggagggatttgacctgacctttgtggactatgaggacgggcgggaaaagacgctgcacgtttcctccgcatccatgagttccatccacacggagtacgactaccggggaaaaggccagtgcgttaccttgtcggtaccggacaatacctatttcctgttcccgctggaggagggctttaacgccacggaaatacagttcgcagtggaggaattctttgagcggagtcattcctgacgcgcgatggattcgctggcgagaatttcgatctccatataggagagaactttgtttcgggcgtgctcggagagaaaattatagtagtagaccgcgatatatccgaacataggcggctttttgtaaaattcggaggaaggcagcatcatatcctgggaggatcgggtggctacctcgatctccatgtaggcgaaaatggtggcttttgcgctgtccggcagcaggttgaagtaattgaccagctgctgggggtctaaggccgccagcatcccctttctgagggagacatttttttccagattctgctggtggcttgcgtaataggcgctctccacaaatgcatctaaggacagctggtagtagttgcacaggtcgataatcaccttggccggaatttccatcagccccttctcatatctgccgatggtgctcttggtcttttggaccacagcgcccagttcctcctggcttaaatcattatattcccgtaccatttttatttttttccctaattctatcatatgatctccaatcaagccccgatccgaaggggattctgtgaaagttgcttcaaaaaagttgcgtatacgcaataaaaacgtagaaaatccattgacaaattgcgtatacgcaactataatgaagaaaaagaaatattttgactataatataccacaaaagttgcgaatacgaaacaagaaatagtattttatacaaaaatttagcggaaaggcaggtgagctggactttaagcggggaaaattttagaatagcaaaacagacaaacagagattggaggggtaataatgaaacaaaaggtaaaggaaggcggaaaaagagggatttccatcaatatgctggtattcattctggggattttggtctgtgccagcctgttgacgtatatcattccggctgggcagtttgatgtgaatcccgagacaaaagcactgattccgggtacataccacgcggtggagcagacgccggtcaacctgtggaacgcgttgcgcaacatatttaccggcatgaccaactcagccaaggtaatgagcatcgtgatcttcatgggaggtgccctgaaggtgatcatcagcaccggagcggtggaggaatttctcaactgggcgatctacaagctgcagaagaaggggatcgcggtgatcgtgccgctgatggtgattctattctccgtcctctccgcctacgggggaaatgattcgtttttcgccttcaccgtgatcggagtggcggtggcggccaaaatggggctggatcccattgcgggaatggccatgacttattttgccaccagcgtgggctttgctggggcgttaaagggcagaacgctggtggcgcaggggatcgcagaggtgccgctctactcgggggctggctggaggaccgtgtggctgtttgtgatcaccggtctggcggtcgcctacgcgttgtggtactgtttccgggtcaagaagagtccggccagaagctttatggacaacacggactggatggtggggggacctcagggggacatcaaaaaggagctgtttaaccccatgtccctgctggtgattgtgatcaccgccggttccttcatcctcaacgcggttatgggcgtgctgaagggctggacctatccggaacaggtggcggtgctgctggtcgcatccacggtgtgcgggcttctgtaccggaaatcgcccactgagatcgcggaatcctttgccaagggctgccagtccatggggtttgtggcctttatcatcggtctgggcggggccattgcgctgaccatgacccagggaaatattctccacaccatggtcaacgcggtggcggcgccgctcatgcacgtgaacaagggcttcggcaccgtggctatgttctggtttaactggctgttcaatttctttattatttccggttccggtcaggctgcggtggtgatgccggtgctcaatcccatcgccgatgcgctgaatatccaccggcaggtggcggtttccgcttttgtctacggcgacgcctacaccaatatgctgttcccaaccagcgcatcgcttttgggcgcgttggcgatcgcaggcgttccgttaaagaactgggttaaatttgtatttccgtttttggtgatcctgtccgtcctgacgtcggtatttctgtattatctgactgctgtgggctggaccggaatgtaggaggaaaaagtatatgaatatagaagagatcgtcagacgaagcggggaaatactggattatgcggtggagatgcgccgtcattttcaccggcacccggaacccacgtccagagaatttgagaccatccgttttctctgcggccagctggaccggatgggaatctcctatgtcaatattccggatggaggaatcctggccgagatttccggcaaaagcccggaaaacggtgaaacgtcgcctcacgtgcttctgcgggcggactgcgatgctctgaccatggaggagagcccggaaaatggacgcggaccgcgctgttgcctcagcgccaacagcggagtggctcacatgtgcggccacgacggacatatggccatgcttttgggggctgcgaagctgctgtcggagatggtgcccggaaacgtggacggcacggtatacctgctgttcgagcgcggggaggagggcggaaactgcatttattacgtgatgaaatacattcaggcccggaagatccgcatcgacagctgctacgccatccatgtggatccggacctgccgtccggaacgttctggatcagggaaggggcaagccatgcgggtaacgtcaattttgagatcggacttaccgggaaaggcgggcacggctccaggccggatctgtccaacagtcccatcgactgtttcgtgtccattatgaaccagctgaaggacgtgcggatgaagtacatttctccaaccgacctgctgaccgtgaacatcggctccgtacagtgcggacagaagcggaacattgtgccggagtacctggaattcaagggcactgcgcggttctacagccaggaggcgggagggatttttaaggagaagctggacgccattgtcaagtccaacgccgtcttatacggctgcaggccggaatacaaggtattttccggccccagcctgccgctgatcaacaacaaggaggcggcggccatcgcggcggaggcggtgacggagctgtttggacccggatgtctcacggaaggaaagctggggctggggtcggagagcttttccaccctggcggcctattatcccagcgtcatggccaggctgggggtgagaaacgaagatttgggagccacggcggatctccacaaccctcattttgacctggacgaggaggcgctgaaatatgggatcgcctcccacgcggcctacgccattagctatctggaacgccgcccccatattccgtttgagccctttgagggcacggcggacgacctgttaaaattgatgaaccgtccggttccgaagcggtatgacgagtcatgacgtttggtccggcaggggaggcctgcggcattacatgcgccgcaggcctctttttcggatgagtgttaaaaaaatgtaagtatttacaaagagattggccggacagcccggggtcaggggagcttatttttatgcgagagtccaaagagtcagagagttgaatactataaaatcgcatatgcgaacagataacggatatgtgaaaaagacagaaaatgaaagtgcttacaagcttttttactgcaaaattaatacaatttttctagtatttcgcagaaaaaccctttactcatcctgcttttgtgatataatggacgaggtggacggacaggcagatacattagctccgtccgattttaagataggcaaaaacagacgtagaaagccaatctacaagaaacatgaggaggaattaacttatggcaaaatgggtttataagttccacgaaggcagtgcggcaatgagaaacctgcttggcggcaagggctgcaacctggctgagatgaccaacctgggaatgcccatcccccagggatttaccgttacaactgaggcttgtaccgagtattacaactgcggcaagcagatttcccaggaaatccaggatcagatttttgaggcgattacctggttagagggaatcaacggcaagaagttcggcgataccgaggatccgcttctggtatccgttcgttccggcgcccgcgcttccatgcccggcatgatggacacgatcctgaacctgggcttaaacgacgttgcggttgaaggctttgccaagaagaccggcaaccccagattcgcatacgactcctaccgcagattcatccagatgtactccgacgttgttatggaggttccgaagtcctacttcgagaagatcatcgacgagatgaaggaagccaagggcgtacattttgataccgagctgaccgctgacgatctgaaggatctggccaaccgtttcaaagctgtttacaaagatgcgatgaacggcgaggagttcccgcaggatcccaaggatcagctgatgggcgctgtgaaggccgtgttccgttcctgggacaacccccgcgccatcgtataccgccgcatgaacgacatccccggcgactggggcactgccgttaacgtacagaccatggtattcggcaacaagggcgagacctccggtaccggcgttgcgttcacacgtaacccctccaccggtgagaagggcatctacggcgagtacctgatcaacgcacagggcgaggacgtggttgccggtgtgcgtacacctcagccgatctccaagctggcggaagaccttccggagtgctacgaggagttcatgaatctggctatgaagctggagaaccatttccgcgacatgcaggatatggagttcaccatcgaggaaggcaagttgtacttcttacagacacgtaacggcaagagaaccgctcccgcagcgattcagattgcctgcgatttagtagatgaaggcatgattactcccgaggaggctgtttgcagaatcgaggctaagtccttggatcagctgctgcatcccaccttcgttcccgaagctctgaaggccggagaagtaatcggttccgcacttcccgcatccccgggcgctgccgccggtaaggtttacttcaccgcggacgaggccaaggacgccggcaagggcggaagaggcgagagagtgattctggttcgtctggagacctctccggaagacatcgagggtatgcacgctgctcagggtatcctgaccgttcgcggcggcatgaccagccacgcagcggtagttgcgcgcggcatgggcacctgctgcgtatccggctgcggcgagatcaagattgacgaggaagcgaaagtcttcgagctgggcggatacaccttccacgagggcgactacatttccttagacggctccaccggtaagatttacaagggcgacatcgccactcaggaagcgactgtgagcggaaacttcgagagaatcatggagtgggccgaccagttcagaaccctgcgcgttcgcaccaacgccgacacaccggccgacaccgcaaacgctgttaagctgggcgcagagggcattggcctttgccgtaccgagcatatgttctttgacgcggagagaattccgaagatccgcaagatgatcctttccgataccgttgagcagagagaggaagcgttaaacgagctgatcccgttccagaagggcgacttcaaggctatgtacaaggctctggagggcagacccatgaccgtccgctacctggatccgccgctgcatgagttcgttcccaccgatccggaggacatcaaggctctggctgaggacatgggcatgaccgttgaggcggttaaggcgaaatgcgacgatctgcacgagttcaaccccatgatgggccaccgcggctgccgtctggctgttacctatccggagatcgccagaatgcagaccagagcggttatggaagctgcgattgaagtgaaggaagagtgcggttacgacattattcccgagatcatgattccgcttgtaggcgagaagaaagagctgaaattcgtgaaggatatcgtggttgagaccgctgagaaggtgaaagctgagaagaattccgacatccagtaccacatcggtaccatgatcgagattccgagagctgctctgaccgccgacaagatcgcggaagaggcagagttcttctccttcggaaccaacgacctgacccagatgaccttcggcttctcccgtgacgacgccggcaagttcttagattcctactacaaagctaagatctacgagtccgatcccttcgcaagactggatcaggagggcgtaggccagctggtgaagatggccgtcgagaagggccgcgccgcgagagcggatctgaagtgcggtatctgcggcgagcacggcggagatccgtcttccgtagagttctgccacaaggttggactgaactacgtgagctgctcaccgttccgcgtgccgatcgcaagactggctgcggcgcaggctgcgttgaacaataagtaataatcgtttgttcggtaaaaaccatacttgattttgcaagtagtgtttgatataatgctagcaggcaaaagagagaagttccagatgtatgtacaaagcgaaaaccccaggagtaccagtcctggggttttcattaggctaattgtcgcgattaacccctatctagccatttgcaaatgaagtaggcaacgacacttgctgtgatagagagaataaaagagaaaagttccattatgtatgcacccccttcctgttgccagtgtagggtgcgacaacggatatattatatcataagaggataagtaatgttatgatatatgcggaaaaaggattgctctgccaaggtcacggcggcccgggcggcacggaacaatcagcaagtttggaaaatattgacgaatatataagcgaaccccagagctgcggctctgaggtttttttgtatacaatgggctgcaggcgcaggattaattgaacgctgcccgaatcaaccaacctgaaacgccttgcggaaatagtcgatgatcagcatggccgggtgggaaatggtgctgtttttctgggtgacgatggcgtaggggcggaaggccttggcggagatacggtagtagttgggactgttttcggtggtgggcgcttttaccaggacttccggcacaaagcccacccccagccccgtgcccaccagggtgtccacggtgtcccaattcagggtttcgcagatggtgcgcggggtgaaaccggcctcctcgcagagctgatggctcatctctgagaatttctggatggatttcagggagacgaagggttcgttgcgcacaaggcgcaggtcgatgtaggagataccggaggacggcgtgatcagcgcgttgaccgggtgatttctgggcacggccaggaaaatttcttcctggtggattacttcatagtccaacagcgggttcttgggatataggggaagggcgcagaaatccagctctccggccgccagcttctcctccaggtacacggaatgttcctcgatgatgttgaactggagccaggggtaacgctccagcacatgggggatgatcttgggcaggtagtatttgctgtaaaagggggagatgccgaagtggacgatctcctggttggagttggccagagacgtgatccggcgcatcatctgttcatagagctggagaatgacctgcccttcctggaaaaagatctcacccgcctgggtcagctcaaagttccggttcccgtgcacgaacagaggggtattgagctcggattcgattttcttcatatactggcttaaggccggctggctgacgaacagcttgtcggctgctttgctgatgctcttttcctgtgcaatggtgacgaaatagttgatggagttaagctgcatggatacctctccttaaaatataatttttacttatattaatattgtataatctgatttgactgcggtcaatcattaagttaaaattatattatctatcaatcatgtatttatacatacgaggaggaaggtatcatgcaaaaaacgttaaagagaggcgcggcgttctgtttggcagcaatgatggcactgacagcctgtggcgcaaagtccggcaattcgggggaaacgggcggacaggcggcggagacgaaggcgcaggcagaggaaaaaactgaggtgcggcacctgacgctggcggcggtggcctccagctcagggctgttcccctactgtgtgtccatcggaaaagttctctccactttaccggaactggatattacagtttcggagtcgggcgggaatgtggataatacccagcagctgcgggcgggggagatttccatagccaacagcatttccaacacggactatgagagttatacggggaccggcagcacctttaaggaaccgtttaaggatttcagaattctctggtattatgagagctcgcccattcagatctgtgtggcaaaggacacggggattgcgtccctggaggacctggagggccagactttcaatcccggcggaaccgggaccgcggccagcgtggtgactcatgaggctcttgacgtgctggggataaaaccggaatattttgaggccgcccaggcggacgcggcggacgcatactccaaccgccagattgtaggcgcggtgaaaacaggtccgttcccggacagctatgtgatgcagctgaataccaaccgtcccatccagatgatcaacatcccggacgagcagttgaatacaattttagaagccattcccagcgtgaaaagcgcggtgatcccggcgggcgtttacgatggcgtggactatgaggtacagaccttatccacttatcaggggctgcaggtggatatgtcgttttcccaggatctggtctaccgcatgtggaaagccatgtgggaggaggaagcggatacctggaaaaacgcttatcagatcggcgctgacaacaacattccggaactgactctgaaggctgcgtccaccccgcttcacgccggaaccgtgcagtatctgacggagctcggatacgaggtgccgcaggaactgattccggaggagtatgtgccggtaaatccgtaagatgtgaggagaggctatgcgaaagctaacggggttttgggattatgtggtgaaggcgctttccgtgtgcctgattttattccagctgtacaccacgggggtccggctgttttcggatatgatccagaggagtatccatctggcctttgtgctgaccctggtgtttatattgaagcctgccagaaagggacatgacctggatcatgtcccctggtacgacgtgatatttgcggccgtgtcctgcgccggctgtctctatgtggtgagcatctacaagacggtggtgtataatccgctgcaatggttatccacagtggataaggtgtttgcggtgctgttggtgatcctggtgctggaggccagccgcaggtcggtgggatggacctttccggtgctgggaatcgcatttttgatctatgcgttctggggagaggcgtttccgggaatgtgggcgcaccagaatttttccttcaacaaggtgttccagtccttttatcacggcacaacgggaatctgggggactatgctagggttgtccgccacaatgctggccatgttcggtattttcggagcgattttgtccggcaccggcggggcggagacatttatcaagatcggtcagcgcgtggccgggcgggcaaccggcggctccggcaagatttcggtgatcgccagcagtttattcggcatgatttccggcagcgccatcggaaatgtggttgccaccggcgtatttacaattccttccatgcagcgggccgggtactcgaaagagtggtccgccgccatcgaggctatttcctccacgggcggacagatactgccgccgattatgggggccgcggcctttatcatggcgcagctgattggggtcaattatctgacgattgccaaggcggcgctggtgcctgcggtactatattatctgagctgctttttgtcgatccatctggtgtcaaagcgggatcagatttgcggcgagccggataaaccgacgatccgggtgggagagtacctggtaattctgattccattgggaatctttatgttctatctcctgcgcggctacacggtgatgatgggtgcgttctgggcgaccatcggcgcggtggttacctacgcggtgtggttcctggtgtcggaaaagagcgtggggaaatgcgcgggcgctatgggaagggtctgctttacaacggcgattaaagggacgaacagtattgtggagatgtgcggaatcctggcgggttcccagatcaccatttccctggtgtccctgaccggattcggggtcaagctctcggacctgatcgtctccctgggggagggaaatctgttcctctgcctgatttgttccatgttggtctgtattgtgcttggaatgggacttcccaccacggcggcttatgttctgggggcttccgtgctggctccggcgttgattgcgctgggcataagtcctcttccggcccacttgtttgtgatgtactatgcctgcctttcggctatcacgccgccggtgtgcgtggcggtgtttatggcctcggggctggcgaaagcggcctgggtgagggtggcgctgatctcatgtatggtgtcgcttccggcgtttgtggtgccgtttacatttatttacaatccggcgctaatgttggacggaagcgccttccaggtggttttcgggatcgcgacggctctggcgggcgtgtgcctgatcgatatgtgcgtgaccgggtattggaagaggcctgtcgcgctgcccatgcgcctgctgcttctggcctgcgggattttgctgctgataccggatgtgtggatcagtctggtggggctggctgccgggggcgtgtcgttttttgcggtccagagaggcggaggagacggtgtaactataaaataatcgagcgggtgatcagatgaaacattctttttttgaaaacagggggatgtggctgaagggaaatatccatagccataccacggtttccgacggcgtgtgtgaaccggacaggcagatcagggattatcgggaccggggctatgattttctggcggtcacggaccacaacattatggattcctttcagcaggaattggaagggatttgcctgattcccgggtgggaacgggatatcacttactcgaaaaccaaatgcgttcacctggtggggctttccggccgcccggctggggagcagaaagctttttccatggagcggcccgatccctcggaggtgacggtccagcagctgacggacagtatgcgggcggacggccagttcgtggttttggcgcatccggtattttccaggatggagcccgcggagatcagcaatttgacgggatatcaggccatcgaggtgttcaacatgggttgcgagcgcatctgccatgccgggcgggcggatgtgtactgggacatgcttctgagggcggggcggcgggtgctcggcatcgcctgcgacgatacccacgggaaaacgcagaagagcgaccgcttcggcgggtggatttcggtcaacgcacgggagaaaagcgggccggccatcatggaagctgtgggggacgggaatttctattcgaccatgggaccggagatttacgactgggggattgaggacggagcggtctacgtgtgctgctctccggtgaaggagatccattttgtgacgtatccgccccgcggggcggctcgctacgcgggtgaaaacatgatgaccggggaccggtatgagttgaagggatcggaggcgtatgtgagggtcgagtgcgtggacgccttcggaaatacggcctggaccaatccggcgtttgcggaggggctgggggagagaggggacgaataagagtacgggaagcagcctattccttcgcatacctccacaacgtcgtcctgctgatccccagcttcttggccacagcagtttgattccccttcattcggaccagttcgcggttgatgatgtcgcggttgatctcgtagagcgttcggttgagatcgatggcgtcttctccggaatcggagccgtagatatttttctcctcggacagaagccagctggtatgtaattggctgatataggaggtgtccgtcatacccaccagctcgtccagcacccgtttcagctgggtgtaattgcagggccagtcgtaattttggagcagctccagggctgcgggttcaaatcccaggatctgttttcccagctccgtgttctttttggccatgtagaggcttgcgagcatggagaactcggtcatgcgctcccggagggagggcaggcggattttagaacaggagaattggttgatgaaccgcagaatgcgctccggcagctttctgtttttctccaaaacacaggtgaggattacgcggttgcgctggggaaggctctgctctaaaaggacaaattccaactggcggtatttgttctcggcaaggcggtccagatttttgaagtaataggtctggttgttctcgccaaagggcgagcctgagctgttgatcaggaaggcccagctcttgtcgttgatcagttcacagtcgatcatgatgaaggaattgtttcggagcgggctgtggatatagagatagcgggcgatctgatcttttccgcagccctcctcgccggttatgaccaccggctgggaggtctttgccagcgcgttgatctgcccttccatcattcccagggcgccggaggccgcgtaaaagctgttgtaatagtcgctctccgcctgatttcggttgaagaagaaaatgccctgccggccggcgcccaccggaattttggcttcccggatccggaacagcgcgtagcggtgttcgtccagctccacccattttccgctgatctcgaagagggtgtttttgacggtctgcacccgctcgatcccttccggcggcattgtggctaattccggcaggtggacaggggcctcgtcgccgtgtcctgcgttccagctggaaaaaaagagggatccgttgctgtcatagaggagcagggattccggttcccctgtcaggatcgtttcatacaatgtcttgcgctccctcatataggcgtaaccatagctcatctccacggcctggtcaaaggccgcttccacgctctcgtccccggaaagcacgaggatgctggcgagccccatcttttttgcgtaattttcccccaccgtgccgcagatgaccatggaaatgcccctctgctttaaatcttttatggcctctttcgcatcttcctcgtgataaatggtgataatttccatatccttctgcagcaggtcgcagagaatccgcgcccctttggtgattcccggaaatcccagcaccgcgtagcggtagggatagttttccgccagcttgatggtccgcagaatgtcgtaggctgagaagtccacagaaatcaccgggatgtgcacttcttctttgatcaggcgcgcggtggcgcctctggaaatgatcacgtcgtagttttcattctgatggaatttggcgatgtcaacgccctctttcatatttcccaggtaaatgtccacagacaaatccggtctgttttgggcgattttgaccatcgccgcccgaagcgcctcatagggcgcaattcccaagattcggatggttttctccatactgtattcccccataaaatgtgtttgcatgccggaagacggcacgccggacagcctcagagctaaaaataccgggcggcggcggccggcaagagcctgcgccaggaacattttttatttaacgcaactatcaatatttgaaacaagtgtaacatattggaacgaaaatatctatattttttgtaaaatgtttcaaaatttaacgaattggaagttgaatgaattataaaaattcgataaaatttctatgaaaagtttcaaatgttaaggagggagtatgaaacgatttgatttaccctacgggagaggaacgatttccctttcgcttcctgagagccgggtgaaggcggtgctggaatcgcatcttcatacctaccgccccgatatgggggaagaggaattggtgaatgcggcgctggaaagcccggaaggttctcccaggctgagccagttggcgaaggggaaacacaatgtggtgattatcgccagcgaccatacccgcccggttcccagcaggtacattatcccggccatgctccgggagatacgggagggcaaccctgaggcggatatcacgattctgatcgccaccggctgtcaccgggcgcctaccagggaggagctgatccagaagttcggcggggagattgcggggcgggagaagatcgtgattcacagctgcgaggattcggaggatttcgtttccctgggaaccctgccgtcgggcggggagctgatcttaaaccgcatggccgtggaggcggatctgctgtgcgcggagggcttcattgagccgcactttttcgcgggcttctcaggcgggcgcaagagcgtgctgccgggggtggcggccaggaagacggtgctggcgaaccactgctccgcatttatcgacagcccgtacgcgcggaccggaatcattgagggcaaccccattcaccgggatatgatctacgcggccaaaaaggctggtctggcgtttatcgtgaacgtggtgattaaccagaaaaaggaaattattcacgcggtggccggggactgcgatctggcccacaaaaagggcgtgagctttcttaacgactggtgccgtacgccggcggtgcctgcggatatcgttgtctccaccaacggcggctatccgctggaccagaacatttaccaggcggtgaagggtatgacggccgcggaggccacagtcaacgaggggggcgtcattatcatggccgcgaagtcggaggacggccacggtggacaggtgttttacgagactttccgggacgagccggacgtggaccgcatgatggagcgttttctcgccaccccggcggagggaaccataccggaccaatggcagtcccagatttttgccagggtgctgaagcgggctagagtcatttacgtgtcctccgccccgccggaaatggtgagggcgctgcatatgataccggcagactccatggaggaagcgcttcggatggcggaccggctgcttggaaggccggatggaagcgtcacggtgataccggacggcgtgtccgtgatggtgaccgcaccggagaacgggagcgcggaaatataacattttagcaactgttcagggcggctcatcttcttgaccgaaaaagacggtcaagaagcatcggatgtccatccgatgtggaaattggcacaaaaagcagcttacaggcaagcttgacgctgctttctgcaccaatttttccgccgtcctgaactgttacatattttacagaaagaaaaggtaggtatttcagatgaaactgaatcggaagttttatgcaaaatttctcctggtctcgattattgtctgcctgatttccatttttggaacggctctgatcgatacgaattttggcagcgtgatcaccaaggacatcaagatcgtagacagcctggggcacgatatcggcctcaccatttaccagccaaagacagccacgccggagaatccggctccctgcgtcattaccctgcacggaagctacaacgggcgcgagagccagaatttcatctccctggagctggccaagagaggattcgtggccattaccatggactgcgacggccatggggacgcatccaactggaaggaaaatcccatggacgcatttttcctggtgacggccaatccgggcagcagcttcgaggatatcaccacggctcccacctccggcatggccgatgtggtggagtttgtatacaacaatctggcgatcgtggataagagccagatcggcatccagggccattccctgggcggtaagacggcggacgcctgctatgcttattacaaaattcaggaatatctgggaaaacccaacaagatcgcggccgttttcctcatgggcaaccagcagctggcggtgaacggaagctggcttccgtatctgaattatgatccggacgacgttctggagagcggagacgagatccatctgccctacgacgttcactacggcgtcagcgcgggcgcgtttgacgagaacaactacaccacggaggcgggaggcccctggaccttcccgagctccaacaacgcccgggtgttcatcaacgagctggacaactacaatctgacccagacggaatccgtagaggtgggaaagatttacaagggaacggtaaacggttctgatcaggagtacatccgcgcgctctaccagccaaaggaaatccacatggtgaatccctattcaccggcttccaccagaaattccctggatttcttccagaacgctttcacggctccgaaccccatcgctgcaagcagcatgacgggacagtattccatgattctctcggtgctggggatgatcggcttcttctgcgcggtgttctcctcctgctgcctgatgctgacctccaattacttcagcagcctgctggtgaagtccccggacgacgtgtatatgccccaggctccgcagaccgcgtttaccaagttcctgtattggggctttatggcggtgggcgcgtttatcccgattacttatatgatgaagcttgccatgtggatcggcgggcacaagggcgagacctttgcggccagaagcctgttcggaaccagaatctggcctcagggcctgctgctggagcagtcgctgtggtccgctaccgcgggacttttgacggtcggtattttcttcctccgttattatctgtccaacgggccaaagctcatgcccccgtcccagtggaacatgaagattgacaagaagaatatctggaaaaccattctccttgcggtttgctccgtgggagtgggttacgccatcgtgggcttcggacacttcttctttggccttgaattccggcttgggaactttgtaatccgctggcccgccaaggaaccgttcctgatttccttccggttcatgatcctttacggactgttcttcttcagcaacgcgttcacccagaatatcgggcgtatggtcaaggggagaaaggaatggctcaacacccttttgatgtgcgttgcgaacagcatcggcctgttctgcctgtggatttaccagtattacaccttctcccaggtgggcaaggttccgttaaacagtgcccgcgtgatgcagacctggagcctgttcatcgtgcagaccgtgtgtaccattattgccagaaggctgtatctgaagaccggtaagatttacctgggggcgctgatcaatacgattatgttcgcaatgatcgcctgctgccataccatgacgctgaatgtgaccaactggtggttctgatgttgagtggccccgcgccccggggagccggggcgtggggccaccgccaggatggacgctttttggggtgggaggtttgacctcgtccggctctttgatgtagtcctctcgcagatagtcggtggaaacgccgaagcactcgctcaggatcacgatttttcgacttcgggaaatgcgatgccgttctaccatccaagggcttccattttgtcggcttctgggaccccaaagcatcctttgaactattaggccgaataatacttaccgggaattggggagagctgaacgggcatctgctttttcggctgggcctccagcaggaacggcacgatcccatcctccggtaaacggtttccgggaagaatggtctgcttgtcaaatttataggttacgcaccaggcatccgcaccagcggccagggacgcgcccaacgggaagcagaactcgctttgatcgtcccgaaggatgtcgatgaactcacggcagtcatcgggaacggtgtcgttcacctttattttactgacagcctccgccgtggccgtcagccactccacatcataaatatgagcgctgtccagggcgaacacaaaaactgcgggaaggtactcttctgtaccggggagccatagagcactgttggcctgtatcaccgcaccgtaaatcaatggggcgttggcgaatttcccacgccatttgtctttgccaaataaaggcgcttttccggccacgtcccggaaaaagccgctttccgtactgcggggagtggcgcggtaaggcgtgagcctgtttaaatccgtgggaacggcggtggctttgcgctgttcagcaaaggcggccccgtcagcctcctcctgtgcagcaatctccgcctgcttgccacggacagaggacatatcgtagccctttttctccatctcggcaattttttcctctgtcatagcagcttcccagccgcctgcctcttttaacgggtcaaatccaaacaatcccataaatgtaacactccttttttataattgtaaaccggatcaatacgcctaaaccaatcgcgcaaaacggtgggcttcttacatcaacaaccacatcgccacagcgcataaaatgattattacgcctgaaatgccagtgttgacccgggcgcctttttctccaaagtgccggtaaacaaacgcattccacccaaacaggttatgtccgttgggatcccaggtccatttccaattaaaaatgccgcccagcaggaacagcgcccccaccgcaatgagaaagagctgccagtttgcttgcaggaatggcatgatccattccataaatcttgtgtataaatcgctcatggcgttcccctctccatctggcgcatatgaaactcaactcgataaacgggaagctggcaatttaccagtccagttcccgaatggcctcctccgtaccaataggaatgccaaaccactccaaaatgtagccgacagtttccctaatacagtcacgggtcaccgtttcaatctcgctgtcgttctcgtcaaattcattctgtaagtcattgatggcgcaaactacctcatccaatcgcttatagttcctatcaaatgctttcatctttgttctttcttcaacttccgatttgtgccgctctggccgtttcctttcaaaggccccgcgccccaggccaggggcactctttccattggccctcgttgtcttccggttttccggtaagcaagtcaatggcggcatccgtcaggtaacccagatagcgttccaccgcgctgtcaccgcaaagcaacttccacattaggctgccggacaagtaagagcttgcagattgacgccagctatgcagacgttcagccttcccggcctaaatatcgaatggtatccaataattcactgcggctgttgatcccccgggaacgccgcactaaggaaacaatctgctgttccataaccgggggctgcagttctgcgtccatgccgttcaaatcgtggcgatttaggcgggaaatacgatcgccagaacggccagtacggctccaatctgtccccagggcataaaatcattccccttatttcttctggaactgcttcaggaagaaatcggtgaacgcctttacttcttcatcttgggaaacatagacatagagtttctcatcctccagccattcacagacactgataccgatatagcccttcctgtccgggtaaataataaattcgtccgtggggaacttgttctgataggccttcaaaatgtcgttccgccgatagaaagtggcgtcaccgcagcccgacagatcgggaacagtgggaattacgacaatggtctgactggcttcgttccagcctacgatcaaattgccgatcttggttttgctgccgtggacaataccgtaattgaaacggctaacgttttccgtgaagccataaaggattttgtagtcgtcgccgttttctaccacttgattgaacagagcacgcatttttttacggttggcatcactttttgtcatatctacctgaggccccttaaacagatttccaaacagtcccatgctaaatttcctcccatgctaataatttgaaatggttttatgccttttaatcaaagacataaagatacttcacaccaacacccgctaacggttctgccacttctggacagtgtgaccacaagcatttttaattacgattgcaatggtgatagtatttaaaaaagattatacctgaacacctggaaaaaagcaagtccccgtgcatagaaaaacggcgcatcgtttggacgatgcgccgcgtgctgttattcgtctgtgtcggccagggaggccagataacgggaaagggcggttgcctgggccttagccgtccgctccaattcctccgggaagaagaacgggagcgaccgggccgccgagttgtagatcaggatgacggagaggatcaggttgcccaactccttaggggtgcatttatcctgggggatctgccagagagccagcacctgttcataaaaccgcgcctgtccctgttggtaagtttcaaactcctccgggcttaagtgcttatagacccacatctcctcctcttgagtcatcacaaagaaatggtgctggcggctatgtgtgaccatatccaaaaaatgatggataatttcttccaagctcatctcctggttttccacgctttgctgtacttcccggagcaaaagcgtgatctcgtagttgatgatgtggatcaccagctcggccagggaggtatagtagtttccgtaaaaaaacggcttggagatgccaacagcctggaggatgtcctggagagtggtgcctttcagcccccgctgggacagcatttccagtcccaccgtcagcaaatcccgccccacttgctcccgttcttccttggaataacccttttttgacataacctcaccgcctttttgttgagataccaacagtttaccacagcggtgggaaaatgtcatgcattcttggagaaaggctttgaaacaggttgcgcattggaactaaaatggagtggaacatgtagttccgttttagtttctgacacctgcatcccgtgctgccccggcaggacaatgaagtgtgagcgcggaaacgggcgcttggacggaagctgttttgcagggattatagtaatggcaactaccaatatcacgatccgcatggatgaagaattaaaaagcatattccagcttttcggattgacggaaggaagttaaaaaggaaatataggattgtgccttcaacaaagttcaagaaggatttgaaactagttatgaccgtgcgttaagcggcaattttgccggatgcagggagtgtcatagcactccggcacatgcatgcgggaagcgccaagtcattgattctgatattcgtcaatctacacaaaaaaacttctcaatattattgaaaataacaatagactaccaacctaaaatcgtttattataaatgtaacgtttcaagttgcggtaaataacgaaacaaggcggaatttttatggaaaagcagcggtataatctcaaggatgtggcaaaattggcgggcgtcagcctggggacggcttccaaggtgatcaataaccagtatgtgcgccccgaggcgcggctgaaggtggaggaagccatgcaggagctggactacacgcccaatgccattgccaggagtctgaaggccaattccaccaagaccattgggattatgattcccgacatttccagccccgtggtgggtaaggtgctgcgcggcatcgagaagatcagccgggactccggctacagcattctgttgtacaacaccaccagaaacacccgtctggaggaggatgccatccaggctttcatgcgaagccaggtggacgggatcatttacctgggcaatacggtgggggacgagatcgccgaggggttaaagcgcacccacgtgccggtggtatttgccatgacccagtacccggacaagtatttctccagcgtcaccatcgacaacgaggaggcggcttatcacgccgtcacttacctgtgcggcaagggccacaggcgcatctgcctgctggccggagaggcggacgaccccaactccggcatccccagaacggaaggatactgccgggccctgggggaacaggggatttcggtagacccgaccctgatcgtctgcggcggataccggttggagcggggctatgaggatatgaagcggctgctgggagagcgccgggatttcaccgctgtgtttgcggtgtcggacgacgtggccatcggcgccatgcgggccgtccaggaggcggggcttggggtgccggaggacctctccatcgtagggtttgacggcatcgagatggcagagtacacctttccggggttgaccaccgtgtctcagcccttcgagaagatcggggaggaggcgtccaggctgctggtcagccggatgaaggatgggaaacggggcgggaatctggtgctgccctttgcgctgcaggagcgcgaatccgttctggggctggcaggggaaactctgccgtagaacccggaaacggaggggttttttagtcaaaaaatgaaacgtttcaagtttggaacgaaggataaaatacacaacaaaaaggaggaacatatggtcacagctgtagaaacacactatcacacaatcgcgtcgggccacgcttacagcacggttttagaaggcgtgatgtatgcgaagaagtatgggatgaaggggctggcggtcacggatcacggacctgcgatgccgggggctccccacatctggcattttggcaaccagtcggcaatcggggaggaagtagacggaatccgtatcttccggggagcggaagccaacatcatggactatgacggcgggctggacatcacagaggagtttttaaaaaagctggactgggtgatcgcctcctaccatgtgggctgctgcccgccctcctcagtggaggatcatacccggggatatttgaaggtcctggagaatccttatgtggacgccctggggcacagcggaaacgacgactatgtgtacgactacgagaccgtggtccgggaggtgaaacgcctgggcaaggtgatggagatcaacaaccactcgcccatcggccgccccggctccggggagcgctgccctgtgatcgccaggctgtgcgccaggtacgaggtgccggtggtgatctccacggacgcccactttgcggcgaagatcggacaggcggactgggcgtttgagatgctggaatccgtgggttatcccaaagagctgatcctgaaccgggatctggagacctttgagcgctatctggccgggcggcccagaatgcagaagtaaatacagcgtacggcggcaaactatttttcacccccagccctggtaaagacgggcaaaacctgaatcggttgttttaattagtaactgttcagtaggtccgcgcacttgctgcgctgaccgtacgaaaatctgagcttgcaggcaaaaatcccatcgacgaagtcgattttaaatggatttttgctcgtatcggtgaaggtactgaacagaaacttaaattttatcatatgaaggagaacgtatcatgaaaaagagaatgacaaaggttgcggcgattgcaatggcggcggctctggcggcgggaacgctggccggctgcggaggctccgggagttccggcggcgtacagagcgccggggcgcctgcgggcggcagtggcgacagcgggaaagcggcccaggccgtgaccctcaactttgcgattcccctggccgaggaggagtggcaggtgttccgcgatgacattctggctccctttgaggcggagaccgggatcaaggtcaacggcatccagatggagaacaaggacatggagagcaagctggaagctctggcccaggcgggcaagcatgagatcgacgtgttcgcgcccagcaccgtgtacctgccgggaattctgggcaaggacctggccgaggatctgaccggacaggtgaccattcccgaagccatcccgggcaacctttacgaggagttgatgttcgacggcaaggtgaccgtggtacccatccgccccaacgtgcagaccaactattacaacgagaacaagctgaacgagtacggcctgaccccgcccaagaactgggacgagctgctggacttcgccaagaccctgcacgagaaggagggcgttggacgggttgccatccaggccgcttccggctccgcgctgaccatcacctgccttgaattcatccgttccgcaggcggcgatcccctggtgctcaacgacgcaggctccgtggaggcgttcaccttcctgcagcagctgtggccctacctctccccggaatccaagcgggccgactttaacggcgtaaacgagcttctggccacggaatccatctactacggctccaactggcctttctgcgccaccacggtggtaaaggacggcggcaagacggaggtcaagtcctatgtgggctttgagggccccaagggcatttccaaggtgaccaccaccacggttgtgggcattgcgaagggaaccgagcacaaggaggaagcgcttaagtttgtggaatacctgatgtccgagaaggtccagaacgtgctgttcaccaagatcggctgggcaccggccagaaacgacgccttaggcgaggtggaggagtggcagaagccctacattgaggacgtgatgaccgccctggatttcgcccagtccagacccatcgtgccctactggtctgatgtggacaaggctatcaacgacgcgtttactgagatcgtgatcaacggagagagcgacgtccagggcattctggacaagtaccacaacaccatcgaggaagcgaagcaggccaagggcgaataactctaagaggaggataccatggaaaagacagttggaaagaacgggacgtccctgtggcttaaaaagcacgggctgaacaccgtactggtggctccgttaatgatctttgtgtttagctttaccattgtgcccattttccagacgatcctcctcagcttcaaggatcagattacctccgagtggacgctgcgcaattacgtctacgtctttggccgcagctttttctcggaggcggtaatcaacactctgtttgtgtcggccatcgggcttttgattcaaatggtgatcggttatctgctggcctcaatgctgaggaagaattttgtgggaaaaggcctggccaggactttagttatgctgcccatggggattcccaccatggtgtccggcgtggccatgctgtatttattcgggatgtccggctatctgaacgagattttataccggttgaacgtgacgcccatccccatcgactggacggccaaccgccttcgcagcctgtttgtggtggcggtggcggactcctggaaggtcatgcccatggtggtgatgctgtttttatccggtctggaatccattccgctggagctgtacgaggcggcggatgtggacggcgcgggcaagttcgactgcttccgctacattaccattccccagttaaaggccacggtgaccatgacggtgctgaccaggctggtggacctgctgcgaatcttcgagctgcccaaggtccttttaggagggaccaccccgtttttggctaccatgtcctacgaggagtattcatatggaaacaacgcatactcggcggtggcttccacggtgcttttggcgttgatcctggtcattgtcatggcctatatgtttgcctttgagagagagaagaaggggggcggcagaagatgaagaaaacgtgcggcaaagcggccttttatgctgcgatcattgtgatctgcctgattatggtgacgccggtgtatttgctggccaaggtatccttcagcgtgaagagcgagattttaacccagcatcccacgctgctgattcatcagttcacatgggaacactggctgaacgtgttccgctcggggaatctctgggcgcccttaaaaaagagcctgatcgtgtcctgtctgactaccgtgggctccctggtcatcgtggttccggccgcctatgtggtgtcccggatgtcgaagaaaaagcgctacgcctttgtgctcggcctgtttttcacacggatgatccccagcgtggccatcgccctgcctatctccgtgacatttttgaaaatgaacctgatcgacacgtccctgggcctggtgctggccaatatgatcacccagattccctttatggcctggattctggtgtccaccttcgccgaggtgccggtggccctggacgaagcggcctggatcgacggcgcttccaggctgcaggccattgtcaaggtgatcctgccggtgtccatgcagggcattgcggtgagcgccatgtatgtgtggctgaacgcctggaatgaatttacatacgccatgtatttgtccaacaactccaagaccctgccgctgcagatttattactacgtgtccaggggaaatgtgtttgagcgggcggcgtattccaccattctggcgattccggtgattcttgtcacatttgtgcttcagcggtacttgaaaccggactatttgggaggatctgtaaagggatgacgacgaaaacaactggaaccatcaaaggatttatattcgacctggacggcgtgatcgtattcacggacaagctccattaccaggcgtggaagcagatggcggaccgcctgggaatctcttttgacgagacggtcaacgaccgtctgcgaggggtgagccgggaggagtccctggacattatcctggaaaattaccacggcccggcgctgggcgctgaggagaagcggcgtctggcggaggaaaagaactcctattaccgggagctgctggaggaactgacccaggaagcggtggaggagaatgtgaaggacacgctggtaaagctgcgggagcggggattcaaactggccatcggctcctccagcaagaacgcggggctgatactggagcggaccgggatcgcagggttgtttgacgcggtgtcggacggcaacaacattcagcgttccaagccggacccggaggtgtttttgaaggccgccgcgtttttgggccttgaacccggggactgcgccgtgattgaggacgcagaggcgggtatccgggcggcgaaggccggaggcatgttcgccgttgcggttcacagcgcggcgggctgtccgctggcggatgagagcctgaagacctttgaggagctcttaaatattgggtaagcgtaaggagatagaaatggacaaatatacactgtgcacagaggatttctccctggacaaccaggagctgcttctgggagagactctgtttcacaatgcaaacggctacctgggcgtcaggggatgctttgaggagggatatccccagggcttttcccaggtccggggcacctatatcaacgggttctacgatttcgcgtacatgggtcaggcggagaagctccacggcctggtggaggagaagcagacgatcttaaacgtggcggacacccagaccatcaccctgaagctggacggggaaaatttcagcatgtttgagggaaaggtgataaaaagccgccgggttctggacatgcgaaaggggatcaccctgcgggaaatctggtgggaaagccctgagggcaggcaggtacgcataaaaatcacccgaatggcctcctttgtggacacctccctgtttttggtccggtatgagctggaaccgctgaatttcgacggaaccgcagagctggtgtcggtccacaagggggatgtgaagaactttttcgaccccaacgatcccagggtggccggggaggagattcagcacattctgattggggagacctgggaggaggcgggggcgtcctacatcctgtcccacacctccaaatccggcggcaccgtgtgcagcgcggtgaaaaacgcggtggaggaaccggagcaggtggaggagcacagcctcagcctggaaacgggcctggtccgcgagaccttccgggtgaagctggtccgcacaaaatgcttccgcctgctgaaatacacggtgctgtgtgattcctgccactttacagacccggcggggcaggcgaaggaaaagctggaagccctgaccgcacagcctgcccgggcgctgtacgaggaccaggaacgttacctggacaggttctgggacacctgcgagatcgacgtgtacggggatggggaattaaaccgggccctgacctacaacgtctaccaactgctccagtccgtgaccaaggaccgctacggcaacatcgcggccaagggtctcagcggcgagggatacgagggccactatttctgggacacggaaatgtacattctcccctttttcaccctgaccaaccgggagatcgcaaagaaccttatcggctatcgctaccagattctggaaaatgccaaggagaacgccagacagatggggcataagcagggggcgctgtacccttggcggaccatcatgggaagcgagtgctcggggtattttccctccggaacggccgcctaccacatcagcggggacgtggcctactcggtggtcgcttactatctggcctccggcgatctggagtttatggagcagtgcggggcggagattgtggcggagacggccaggctgtggatggacctggggtgctggtatcaggggaaattccatatcaacgaggttaccgggccggacgaatacacctgcatggtgaacaacaattattacaccaatgcgctggctaaatacaacctgatctgggcggcaaggctgtaccgcaggctaaaggaggcggggaaggcagacgggcttgtggagcggaccgggctcacggacggggaggcggaggcctttgtaaggaccgcaaaggcggtgttcctgccctacgacgaggagctggggatcaatccccaggacgattccttcctccagaaaaagctctgggacgtatcctccatcccggaggaggaaaagccgctcctgctgcaccaccatcccctggagttgtaccggtatcaggtgtgcaagcaggcggacacggtgctggcccacttcatcctggaggaggagcaggacctggagaccatccgcaaatcctacgcctactacgaaaaggtgaccacccacgacagctccctgtcctcctgtatcttcagcatcatggcggcgcggctgggtatggtggagaaggcctacgggtatttcggggattcggctaaaatggacctgtacaacacccacaaaaataccaaggacggcatccacaccgccaacatgggcggcagctacatgggcattgtgtacggcttcggtggccttcggatcagggaacagggcctgtccctgaggccctgccttccaaaacagtgggaagggtaccatttccgcttcctctacgaggacagcgtgatcgaggtgaaggccggccgggaaacctgcgcggtgacgctgctgcgggggacgaaaaaggagattacaatttatgaccggccgtatgtgctgcgggatcgggttgagattcccatggagtaagggcggcggggatattatattaggttatacctgaaaaaggcagttgatgattaaaacatcagctgcttttttgtatttttcgccaggcatttcgccgggatatcaccccttggcagcggcagaatatgcaatcgttaaaaattaattccccctctgctaaaacgtcatatttaagacgtttttgtgattgtaaattgtttgaaaatattatataattttattaatatttcaaacatggaggaggctagggggatgatgtatacatttttggggcccaatctataaaaatggagtggtatccctcgagatgataggatggaaataacttaaagaatatgaaacggcagtttgttaggatggtgataacgaatccgatgaagggtgtcaggctgataaaaaaatacgaggaggctaagcgatgttgaacatgaagaaaggcggacgggggaaccgcaagcggaacatgattccaggatttttgctggtatttttgtttgtatttaccatgagcttcagtgccatggctgcacaggaggacaaaatattcttggttggcggtcttgacggcgacggtgaggtcatttccatggtaactgcatttgtggtgaatgacggcagcgaggattatgtaatgaccgatgcctctatttttaatgataaggcggtgctttatgctctggctgataccgcgggaaacgcctatatagttgaagatgcgcagatcgcgtttccggattacaacgtggttctttttacctttcagagtgaacgcccggaggcctcaaaaattttgcagctgacaggcgcggtaaaaaaccagatggtggagctggtatatgtgaaccagaatgactccgtggatatctgcgaggtaaggttattagaggccgaacagggcgtaccggatataatcacggtgatgtcgggcgagaccgacggggatgctccgaatccgatgagctatccgggaggatttttcgatgcaaatggcggcttggtaggtctgtacacttccacaggcgatattgtcagcttcaatacggatgtaaacgccttctacggccagtcctccggagacggaaatgagacggagggctcgcgggaaacccagcctgcccgggaaacgcagcccgaacgggagacacagcctgcacgtgaaaaagagaccagcgggactaagagcccgggaagagagcgaacggggagcgggggcagcggagaagaaaagaccacggcttacaaggtgggatacatatttggagccgttttttccgtggtggccgtgatcggaatcatttacctcgtattccgcaaaaagtttaagggaaaacagcagcctgtgcaacagtaccaggcgacaccgccgcccgcgcccagaccgcagcagcccacaccgccacagcctataacgccgcagccgccttccggctttgcggattacacgcccacggctccttataccaccccatctccagccgcgcccccgaggccacaggccatgggaggcagccttatgggcatcggcggggtgatgagcggcagaacctatcccattgcaagccaggagaccgttatcggccgcgacgtttcctgcggtatccgcttcccggcggacaccaagggcatcagcagaaaccactgcaaggttttccgaaacggcggaactgggcagttcatgctgatggactgcaattccacctacggcacgtatctgaagggctacggaaagctgcagccccagaagccggtagcgctgaagaacggggacgccttctacctggggtccgatcagaacggatttacgatcaaatattaatataacaatctaactatcaaggaggaaacagtaatgaacatgaaaacctgtccgaaaggccacttctatgacggagacaccaatgcaacctgcccggtatgcgcggcggagcagggaagaacagcgggtatgatggatgattacggggcgacggaacccgttggaggaggtagttctggcggtttttccggcgtaggcgagacggagcctgttgggggaggcttctccggcggtttttccaacgtgggagccacagaacccgtggggggaggcttctccggcggcttttccggcgtgggagccacggagcctatgaccggcaccaaggcccccacccggggatttaacggcagcggggagaccatgcacctgtttgatgacaaaatcccgggagtggataattacaatgacgagaccatggcggtgaacccgggcatggtggccgggtttaccccggtggtgggctggctggtatgcaccgagggcccggaccggggccatgattaccgcatccgcaccggctacaaccatatcgggcgcgcggagcatatggatatctgcatccggggcgacaagcagatcagccgggaaaagcatgcgctgatcgcctacgacgatacggagaaggtatttttcttcggcccctcggacggcagaaacattgtccgtgtgaacgggaaaatggccatggtgcccacggagcttcacgcttacgatattctgacggtgggcagctccaagctgatttttgtgccattgtgcggggagcagttcgactggaacaactgatcaacacttaagaggtgacggagcatggatctgcaatatttgtgtaccaactgtctgaccggcacggtgagaaacggaacctgtacctattgccataaaagcgtcaatgaggcgtcaaagcagccggccaacgccctgccggtccgctatatgctgggttcccagtattatctgggaaaggtgatcggcaacggcggttttggtatcacctatctggcatgggactgtattgagcagcgccgggtgatcgtcaaggaactgtatccccggcaggatgtccagagggatccggccagcaaaatggtggttccgttaaaggggcaggaggattacttccggaagctgaagcacaggttcaaggaggaggcccagatactctatagcttccgccacgagccgtcggtgatgaacgtttaccggctcatggaggacaacaacacagtttattattccatggagtacctctcgggttttgatctgaaaacctatatggaacaacagggaaagctgggctggcctcagctttccggctatatccggaagattctctatacccttcatatcctgcacggtcagaacctgatccacagggatatcagcccggacaatattttcctgaccagcgtgacggatgcgaagcttatcgacttcgggtccgtgcgcaattacaacagcgggcaggggcttaccaccatattgaagcaggtttatgcgccggtggagcagtattttacaaacggggaccaggggccctggacggacatatatgcgctcagcgtgaccatgtaccacgcgctcagcggcagccgtcctccccgggccacggatcgcgcggtgagggacggggcgatccagatcggacggctctgcccggagcttccggagcatgtggcccgggccatcaccagggggatggaagtccgggcggagaaccgcttccagagcgtggaggagatggcggaggcgctgtttccgggtgagaaactatttgtctcggagaaacagtacgttacagggcggcaccgggaggaggaaaaaccggacgaaggcgccccggcaggaaatgaaccggggactcattcctgtaccatccggtgtacggcgggggtattttcagggcgcaggatcggcatttcaccgggggacagcgtgtccttcggacgggaccggcagtgcagcgttaactatcccgtagacagtccggggatcagccgcagacagttctgcctgtggtgcgaccagtatggaaatctgtttatacaggatgaaaattcgacctatggcaccctggtatcggggtaccgcatcgaaccgggaaagtggtataagcttgaacggggaaacaccatcggctttgcaggggaaaattattacgtggagtgagagggagcagcttatgaaaaaaataacagcattaattctcggcttgatcatggtgtgcaatgtgggacagatgtgcgcctttgccgagacaaaccaggcgtttgtagagcgggcgtatcaggcgcaggaagggcagatggacgtgatctgcgccatcccgggacaggaggggaacggggagaatttccaggcgatgctcggggagcagagcctgccggttctctcagtgtccacggcagagcagagcgggcttcccaaaaccatctactgcctggtggatgtctccggctccatgaaggggagaatggagcaggtgaaggagacgcttaccgccatcagcggcgggctgaatgagaatgacaaccttgtgatcggtaaaatggggaatcagataacggattccgcctttctttccggtcaggaagagataaaagcgcagattgacagtctacagtataccggtgaggatacggatctttacagcggactgattcatgggctgaaattcctccagcaggagccggaggttaagactctgagggcactggtggttctgtcggacggctgcgacgaccagggagccggttccacctggaaggaagcctacgacgcggtggaaaaagcggatattccggtttatacggtggcggtgattctctcggagaaggactacgagcaggccaaggagttagggagctttgccagaaattccgcggggggactgcatttcccgaaatccgacgacaacagctctaaacctcttgccatgacggggcaggaaatggggaaggagatccttaagacattgggtgatacctttgtggtgtcccttgatctgaccggagtgcagaaggcggagaaggatgcctatatcctgtccgtctccttccggagcggaaccggaaccgtgtacgaggataccaaggagatactggctaaaaacatacagctggcagcagtggaaacagagccggaaactctgccggagactcaggcgacggagccggtacccgagccggagccagctccaaagaagagcaatcttccctggatcatcgggggtgcggcggttgttcttgcggcggtcatagccgtgattttggctgtaagttccaaaaagaagaaggctctggcggaacagaagcgcctggaagaggagcggctccgccaggaggaaaaacgtctggaggcagagcgtctggaggcggtgcgccaggaggaagaacagaaacgcctggagcaggagcagctggaaagagcaaggcaggagaaggcccttgcggagcagaaggcctatgaggaggcgctgcggcgggagaaggaggcttacgccgcccttccaaagctgaacatccgcctgtctgccatcgggattacggataagagcactaccctggagctggccaggggctatgagacgacggtaggcagaaacgccaaggccaggtttgtgctggattctaaggatacccggctgtccggcgtccacttcaccatgctgtgggacgggaggggcgtctatgtgtgggacagccagtccaagaacggcacatccgtcaacggagtggtggtaaaccatctgggaaaggtcgccgtcaggccgggagacagcctgcgggcgggcagttatgaatatcgtttatactgggaggattgacagatgaatcagagattgaagaaatgcatattgtgcgccggtgctgctgcgcttctggccgcgtcccccgctatggcggcggtgaatgtgccggcggccacacctgccaattcgcagatggaaacgccggatccgggtaaggaagagcagaccactccggggaatattcttgaaattctggaggaagagggaaacaaagcagggaaaatccagaccggggaacagctgccggaagacggcggcggggactggttttcaaaggagaatcttctcaaaatcgccccctttgtcctgggcggccttgcagtgatccttgcgggaattgcaatctggcgtattttggcaaaaaagaacaaaaatgagcttgaggagaattcggacagggacaacagcgttgtgacagagaccatgacggagacagctcctgccagagaagcgcccaaggttctgccggttcaggataccgtccccagcagccgtccccagcgtccgcaggtttcagcctccacagtgcttccggatgcagagcggggcactctgggtatggtgcacaacgtgggtcgaaggaagaaccagcaggataccctcggcaccaccatgaccaggatggggcttctggccgttgtgtccgacggcatgggcggcctctccgacggggagaaggtgagccagaaagccgttatgggtatgttccaggcagcgggccatgtgtcgcctacgccctatgaaaacccgctgtatgagatgctcagcgaggccaatgagcaggttcttgccatgttgggtccggatcagatctacaagagcggcgctacgctgctggcggtactggcggacaaggggaaattccactgggccgctgtgggagacagccggatctacctctactgcagccatcacctgctccagatcaatcgcgagcatatctaccgccagcagcttatcggcgaggccgtcaataaaaatatcagctttgccagggcaggagcggatccccagcgggaccggttgatcagcttcctgggcatgggagagttaaagtacattgacggaagcctgcgtccggtggaggtaaggcagggagataaggtattgctgatgtcagatggtattttcaatacgatttcagaggctgagatcatgaacatactggagagcacgaaaaatgcagcagaggccgcttctcttatggaaaaacgggtgttggaggccagcaatcccaatcaggataatttcacctgtattattctggacttttaatgagcgtttacgaggagtgacggtatgagaaggataaaatatgggatatggtgcctgctgattgttatttccttaatggcgggagggattacggcctatgctgagggcgagggaaaggctgccgccgcccgggagggcgtggtgagaatcctggttgactggccggacggatactctaccggcacgggatttggcgtaggagaaccgggagcggatgccgataccttcgtcaccaactggcatgtggttaccagcagcggtcaatacgactaccgtgaaggcaaagtatatattctgctggatgatgagacctggtttaaatatgggtggattccgttagcgccaggcgagcagatggtggaaggcggggattatggacaggacggccagggaaatgtgtataaaaaactgatcattgatgtccatctgggcgccgccgtagaatgcgaggtgctgtatgcggaaaatgaatatccggatgttgcagttatccgcacagcggaaccggtcaaaaatgtgaagacgctgcctctgcgaaaggtgagcgagggaaatgtaggggaagatgtgctggcgatcggatatccgggctcagccgatagtggaagtctgacctatacggaggatggtgcagagacagaaaagatcaaggcttcggtgacagcggtttccgtgtcgggaggggtagtatcacgatgtattccattagaaatatttggaaatacagactgcattgtccatggcgcgcatattaatcatggaaattccgggggccccctggtgttaaagaaggatggaagcgtgatcggtatcaatacatatggatacggtgagcagagcatggaatacagcgtttcgatctacattgattatgccatcgggattctggatcagctggggcttccctacaccatggcaaaggacggaggacagggactttccgggcagcttgtgatcattctggcgggagtgggaatcctggcggttctggcagtggtgctggtggttgtaaggaagaaacagaagggaaaggccgcggtgtctgccggttcgcccgccgcagtcccggccttccagcctgcgcccggcccctcaggcggagacgccatgtacggagcgccctcccagttgcgcctgcaggggctgacgggagtctttgcgggccgccggttccagctgaagccggaaacccgcatgggccgggatccccagaggtgcgacttcgtctatcccgcgggtacaaaggggatcagcggactgcactgtatcatcagtcagggaccggcggggctgaccgtcacggacgtgggatccacctggggaaccacggtcaatgggacaaagctggttcccaaccagccctgtcccctgaacatcggagaccgaatctgtctgggttccgttgaagaggagtttcagataaccgggaagggcggagcggtctgaggggggaggaatggaaaatgagcgacaacaaaacattttttaaaaaggcgaaggggggaaaactgggcttctctgatattttcagcgacgtgttccggcgccacaccaaggaggaaaacgccaggctgttcctggcgggaacccctttaaccacccccgatgcggcctccatgctctcgaaatggctgaagccctatctgtttgccaggatttttctggtgggaattgtgctgatcatcgccgggattgccatgaaccttgatctgatggttccgtttgtttttgtggcgggcagttttctgatgcctgtggtagggatgatttttttctgggaaatgaacattccacggaatatatcctttaccacagttcttctgatgtttatggtaggcgggatgctgtcactggtatttacgactattttgggaatgttttatcttacggacagcgcggtcgccttatatgtaagtgttggaatcggggaagaagtggcaaagcttctggcggcggcagtctggctgaggaaaaaggacacaaagtatgtgctgagcggaatgctggtgggagcagccgttggagccggtttttccgcgctggagagcgcaggttataacattgtaaggagcggcggatggaacttttctcagatgcttctgagagcaatgtatgccatagggggccatgtatcctgggccgccatcacggcaggcgcgttggtctgggtcaaaaaggacgaagagctctcggcaaagcatctgcggaacccggtttttctgggagctcttgcgttctctgcgggaacccacgccttatgggatctctatccgggttctgcgctgtcgccgcttctgtttgtgtttaatatcctgattgtctgggtcgcctacatgattatgaaaaggggcgtcaaccaggtggtggagatttccctgagggcaaatgaggaccggctgacctttgccatggaccacgactttctggaaccgctctccggcgtagcacaggcgcggccaaggccgtcccggcccatatccggcggggagatgccgggggtggcagtccggcatggcggaggtatgccgggagtggccgtccagtccggagggatccggctccagtgcgtaaaaggcgctttttccggccgccgctttgccctgacggggcgggtacggattggacgggacccggccaggaacgatctggtatttccctccgggactgccggggtcagcggggtgcactgcgaacttctccttcagggagggcagatcggcatccgggacctgggctccagctacggaacttttgtcaacgggaaccgtttgaagcccaaccagctttgtgagctaaggcccggggatcgtgtgaacatcggatccgcgcacgaggaatttcagattacgctgaaaggcggaagtatttagcagataggagcaatgtatgatcaagacagaatatgccgttctgacgaacgcaggcggacgcgggataaacgaggacacagtcctggcaattccatcttctctggggctggtggttacggtggccgacggattggggggacacgggggaggaagcacggcctcccgggcggcggcggcggccgtctcagactgctttggcagagggctttgcagaaccggggaggggattgtctcagccgtttacatggcaaaccaggcggttctggacggtcagaccgaggcctgcgccatgaaaaccaccctggtcagcctgtttgtggagggagatcaggcagtctgggcccatgtgggggattccaggctgtaccatttccgggacggaaggctggtggagaggacactggaccacagcgtcccccagctggcggttttgatggggatgatcacggaggatcagatccgttttcatgaggaccgcaaccgggtcttaagagcgctcggaagcgacagctttgaaccggacatttcagagccggtttctcttgcggatggttttcacgtttttttactgtgtacggacggtttttgggaatatgtactggaacaggagatggaggaaacgctggcggattcccccgatcccaggcagtggattttgaaaatggaggcgcttttgcaggaaagggcgcccggggatcaggataactatacggcggcgtgtgttttttcgataggggagaagtaaaagatggagatgtaccggtgtgtgaactgcatgcaggaggtggcaaagggagagcggttttgcagtcattgcggctttgacatggaacgttacgttcagccgccgaatgtgctcaggaaggataccattctgtgtggaaggtatctgatcggaagagtcatggggcacggcggttttggcgtcacctatgtggggtacgatctgaagctggaggttaaggtggcggtgaaagagtatttcccctccggcctcgggagcagaagcaacgctcagtccaaccggattcagtgggggttttccaacacggaatatcaaaactggctggagggagtggagcagtttttaagcgaagccaggaaaatggcaaagctggatgaggtgcccgggattgtgcgggtgcgggattcctttcaggagaatcagaccgcgtatattatcatggactttgcggaagggattccgctgaaacagtatctgaaccagtacggctgcctggattaccgcgcctgcaccgcgctgcttctgcctttgatggacagtttggaagccatgcacgccaaagggctgatccacagggatatcagcccggataatgtgatggtgcagaccacagatgcacagatgaaggcaaagctgctggacttcggcgccgcgcgggacattggcagaaggcggtccgggaagtcggagagtattgtgaaggacggctacagcgctccggagcaatacatggaggacggagaaatcggaacctggaccgacgtgtacgccatggctgccgttatctacagctgcctgaccggaaaacggattcccgcggccccggagcgtatgatgaaaccggcccctctggatatggaggggatcaggaataagaaggtaagggggatcttggaacaggctctgtgtatccgggcggaggagcgtatccgcaccatgaagcagttcagagctgccctggccggagccgttcccgggaggaaccggctggcaaaaggacttttggccgctgccgccgcctttgcaatctgtgcggcgggggttggagtttacgccgtgaaaccgtggctgccctccgtagagcggttgggcaccggcaatgcaaatctgctatgtaacgctgggtttgcccagaagatcggcgagcatatgtattacaacgacggagactggaacctgcatgtgagtccctacgatcgggtggacgaccggctgattgtggattcagaggccgcatatattaatctgagttcggataaggtttatttcctgcacgacaacgcggagaatcccgaagagccggattccattatggagatggactttgacgggaccaatgtgaggacggtttgcagcgcaggttattataacgatctgcaatatgtccgctattccgacgggaaagaaatgctctactatctgaagggggaaaacgagggggacggactgagctataccctttgccggtatgatttaaagacgggaaaggaagaagagctgctgaaggaaaaagcagtctggtacaacctggacggaaaatacatttattacaccgtgctgtatccggaagggcaagggaacgcaatcgctctaaaacgggcctatctggacggcaaaaacagtaaagtgctcaacgataaggactttatggtggtggggtttattgaggaaggtaaaatttatatggtgtcattcacaaaggaacagcttgtggtctgtgatctggacgggcggcttgtggagagtccgatgaaagaatatgccgaacagatgaacggggacagcttgtcctacggcaatggttggatctactacagtccggaggacagcggtgaaatccacaggatcaggacggacggcaccggtgattccgttatttacagcggtgaccgggtggttaatatgagctatgcagacgtcaactggctgtggtttatgacacaaaagaccggggggctgttgcagacatatttgttgtactgcgacggaagcaatttgatccagctggaggaccagtgacagggattgcgtgaatgagagaagcataaaagagcttggaggaatcggtatgcagatgagacgttgtatgaaatgtatggaagagctgctggagggcgaccgcttttgccctgtctgcggctatgatcaggacagcggcagccagccctccaacgccctgaaacaaaataccgttctccacagccgctatctgatcggaaatgtcatcggccggggtggattcggcatcacttacgtgggctgggatatgacactggaaatgaaggtggcggtgaaggagtattttcccactggaaccgccgcacgttccaacagctattccaatgagatccagtgggattttacagacgagggaaagataggctggtcggatggaatacagcgatttctgaaagaagccaggaagatggcgaagctggactccgtatcgtccattgtccgcgtccgggacgcttttgacgagaaccagaccgcttatattgtgatggactttgtggagggggttacgctgaaaaattacctcctgagccacggcgtgctgaggtatggggaatgtatgaggcttttgtccccgattctggacagtctggcgatgattcatgaccgcggatttatccatcgggatatttccccggacaatattatgctccagccggacggcacggccaggcttctggatatgggcgcggcggtggatgtgagagccaataaaggccacgcctccatggcggtgatcaaacggaatttcagcgcgccggaacagtatatggaaacggaaattctgggaagctggacggatgtgtacgccatggcagctacgatgtattactgcatgaccgggaaggtggttcccgaggcgatggaacgggagcttaaaaagacacccctttgcttcgatccgaatctctatatcccggtccatgtgatcggggcgttatgcgacgggctgaagatgcaggcagatggccgtatccaggatatgcaggagcttaagcggaggctgaccgcgcaggaggcagatgcctctgaagatacggcgggggatgaggcaataaaagaaactccggtccaggatcagattcccaaaaccgagcgggtggatcaggcggaggagagcggacggtactcaataaaggaagataccgggcgcagcaaacgtctgaagcagggaatgaaaattgcgctggttgcagtgggtttaatgtccacaatgtgcgttctgacgatgatgttctttttattccgcgactctgtaagttcggcttcttccgatgggaaggagtctgcaaaaatggagtcagccggttggaaaacgcaggcaacaacggaaagcagggcgacagaggcgacagaaccctcgcttgaaatcgattatgatttttgctatgaaacggacgagattaagagcggtattatccttaccgagtatttaggcgaggagagttctatcaaactgccgtcggagatggtcggactgccagtgacggagctgggagaatatctttttaatggaaacggtacgctggagaaagtgattttaccggaacatcttgagtatatttcgtactggacattcaaagactgtgtcaatttaaagcaggtggagataccggatagccttagagtaatatatgatggcgcgttcgaaggatgtaccagcctgcaatacttagagctgccggaaggcttatggaagatatcgttgtccgcattccaaaacacgggtctgaaaagtcttactataccgtccaccgtggaagtgcttgaggggagcagcggcattttatcgattgagaatctaacatttgcggagggtaattcgacctataagatggtggacggagtgatttacaatatcaacggcggattgacggattttcctgaatcccggggtggagagtttaccgttccggcagaagtcaacgtcattgaatcctttgcattcaataacacttcgctgacaacgcttatgattccggggaatgtgaaagtaattgagatgtatggggctactggatctcatagtttagagaccgtggtgatggaagatggagtggaggcattgggagacagttgtttttccggttgtgacaatctgagggaggtcgttattccacaaagcgtaatgatgattggcggctatgcctttagccgatgcgatagcctgaaatccgtcaccataagccgggattgccaagtgacagaaagcacctttgatccaagtgtggaaatacagtattacgactaatcgaatcggaggacgacacagatgaaacgatgcacgaaatgtatggaggaactgaagccgggcgatcaattctgccctcactgcggttacgaaccggacagcgacattcagccgcccaacgccctgaagcgggacaccctgcttcgcgaccgctattacatcggaaatgtgatcggccagggcggctttggcattacatatgtgggatgggatttgacgttggagatgaaggtggccataaaagagtattttccttctggctccgccacgcgcaccaacagcctgtccaaccagatccagtgggatttcacgggaaacgggaaggcgaactggtcggagggaatggagcgtttcctgaaggaagcgcggaaaatggcgaagctggactccgtcccggccatcgtgcgcgtccgggatgccttcgctgagaaccagaccgcctacattgtcatggactttgtggagggggatacgctgaaaacgtatcttctgggccatggcgtgctgagatatgaggagtgcatgaccttgttgtcccccattctggacagtctggcggtaatccatgaccgtggatttatccaccgtgatatttcgccggacaatatcatgttgcaaccggacggaaccgcccggcttttagacatgggggcggcggtagatgtggaggccaatgacggccacgcttccatggcggtggtgaagaagaatttcagcgcgccggagcagtacatggaatcggagagcctgggtagctggacggatgtgtacgccatggcggccacgatttactacagtatcaccgggaaggcggttccggaggcgttggagcgggaatttaagaaaacgcctctttatttcgatccggccttcaatattccggcccatgtgatcggcgcgctgcgggacgggctggcgctgcatgcggagaaccgcatccgggatatgcgggagcttaagcggaggctgaccgcaccggtggaggacaccgtccccacgatgccgtttcaggcggggccaatccccactccggtcgtggaggaaacgcagagtaccgggcagccggaacggaaagtggaaagcgggcaggatctgaaggaaaagcagccccctcgtcccggacggctgaagcggacgctgaaaattgtgctgatcaccatcggcgcgctgttcgccatgtcggttctgacggttttctactatgcgtttcagggtatcggggacgctgcatccgccagcgtgcagacaagtgccgccatccaggctgaaaccacagaggaagccgttgccgcacagaccacagaggcggctgacactgccaatcacatgggggagcagatggaaagtgccgtgcagaccacggctgcggaggaacgtgccgatctctcccgcttctataaggttgagccgtcggagctgacctacaagccgactgaggatggaagcggcatgattctcatcagttatatggtggaagaggagaaaccctatatcaagctgccggatgagattgacggattgccggtggtggagctgggagagtccctttttaaagaaaataagacgctggaagaagtgattctgccggagcatctcgaaaccataggcactcaggcctttggcttttgttccggtataaagcagattcagctgcctgagggattgaaaaaaataggcgaatttgcgttctgggagacgtcgatccaggaattgaccataccctcttcggttgacgatttagacagaacgaatttgaggaagatgcaggttaaaatcgcagagggaaattccaaatatgaggtagtggacggcgttctatacacggatggcaataagctggtggcgttcccagaagatcgggaaggaacgtttatcattccctcgaatatcgagatcatcggcgaacaggcctttcgggatacgtctcttaagtcaattacaattcccgggacggttcgggttgtggaggagcacgcgttctttggcggacattcactggaggaggttgtgattgaggagggcgtgggggagctgaatcaatatgccttccgcgattgtacagcgctccgtaaaatcacaattcccggaagtgtgaaggaacttggagcaggggcgttcctggagtgtaccggtctggaggatgttttaatcgaagatggtacggggaagctgggagacaactgttttcagggctgtacgtcgctcagccatatcctgatcccgagtagtgtgaaggtaatcggggaattcgctttttatgactgcggcagcctggaagtcgtgggtgtaagcggagattgtcagattgatccgacggccttttcagcggaggtgcagatcgtccgtttaagttaatctggaggagtcgttatgcaggtgagaagatgtaccaaatgcatgggggaattaaaggaaggcgttcagctctgcccctattgcagctatgagcaggacagtaccgtccagcccggtattgccttaaagcggaataccattctccacggccgttatttgatcggaaatgtgatcggccaggggggattcggcattacatatgtgggctgggatctgacattggagatgaaggtggcggtgaaggaatatttcccatccggttccgctacgcgcaccaacagcatttccaatgaaattgaatgggattcgatcaatggagaatcggagaaccggccggatgggatggaacggtttttaaaagaagcccgtaaaatggccaggttggacgaagtgccgtccatcgtgcgggtccgggacgcctttggcgagaaccagaccgcgtatattgtgatggactttgtggagggagtcaccctgaaaaagtatctcctgagccacggggtgctgggctatgaggagtgcatgagccttctatcgccggttctggacagtctggcggtgatccatgaccggggattcattcaccgggatatttccccggacaacatcatgctgaggccggacggctcggccaggcttctggacatgggggcggcggtggatgtgaatgccagtggcggccacgcctctatggcggtggtgaaacggaatttcagcgcgccggagcagtacatggagtcggagacgctggggagctggacggacgtgtacgccatgggtgctacgatttattactgtatgactgggaaagtggtaccggaggcgctggagcgggaatttaagaaagcgcccctgtattttgatccgggcctgaacatcccgttacatgtaatccgggcgctgaacgccgcgctggagctgcgtgcggagaaccggatccgggatatgcgggagtttaagcgaagtttgacggatgttggggatgaaagggacgatggggatgtgggagagccggaattgcagaaaatgccggagccgggaccgcagcctggctttcagcagatcccgcctaccgcaccttttatgggaaatggcgacgagatgaaaacgactccctatacaggggagccggtggagcagcaaaacgcttcggcagaggagacattttccgggaaaaaagagccggtgcgggtggaaatgaaacagccgatattgaaaaagggatggaggacagcgctgataataatcggagcgctgttcgtagtggggattccggcggtcaagttttaccaggctcaatcggcccaacatgctgagtatgtaaagcggtcgcaagtctttcaaaaattgtgggagacggcggacagctttgaggcggacgaccagttgaacgcctcattggaaagctgcaacagcgcattgaccgctatggattttggaaaggtaacggttgatgaggtgctggtagccaaggatgcagccggcgacaaaatggggtatgtgattgtctctcattcagatgacagttttaccgggatcgtaaaaattgccgtgggattgaaggaaaacggcacggtgaacggtatagagtttttagagatcaatgatactcctaatttgggattaaaggcggtagagccggactttaaggatcagtacgcaggccaatcgggggttcccctgtccgtagtgaaatatgagcggccaggtgacaacgagatcaaagcggtttcgggagcgacaattacatctgaggcagtgacaaatgcggtgaacgccgcaatgttttttggacagaattatgtagccatatccggtcctgtgggatatgagggatgtggtgctgtcggagttagcctatgaaaaaacagagagcgggaagggaattattcttactgaatattttggggaagggaaatctcgtaataagctgccggaggaaatagacggtttgccggtagtgatgttgggcgaagagatttttatgaatcatgaggctctgaaggaaataatattgccggagaatttacagtataaagaagcccgcaaaatggccaggcttctggacatgggtgctacgatttattactgtatgactgggaaagtggtaccggaggcgctggagctgcgtgcggagaaccggatccgggatatgcgggctgatttttaggaacttccgccgactgctccgtttatggggaatggagatgaaatgaaaacggctccttatagaggcgaagaggagcggaatgaaaaaacagatttagatgtgacagagcacgcggggagagtgaggagaaaaagacagagacagcggctgataaaactgttgggaaggtaaaaactgcaagcaaaaagaaatttgtgtttttgggtgtaacgagttgtcttgccaaagaagctgcagagtattggcaagaatacatttagtggctgcacgaatttaaaagaaatagagcttcggaaggttgtaattgaggatggagtgaaaaaattggagtaccgcagtttttaagattgtgaattacttagcgaaatcataatccctgaaagtgtatgttatattggtggaagggcatttgagggatgcaagaatctgaaaacagttactgtaagtaaagattgcgagattgacgcatcagcttttgtggatacagatgttaagatcaactattacgattaattttaaggagtcgttatgcaggtgagaagatgtaccaaatgcatggaggaattaaaggaaggcgtccggctctgcccccactgcggctacgagcaggacagtaccgcccagccctccaacgccttaaaccgcaacaccatccttcacggccgatactacatcggaaacgtgatcggtcaggggggatttggtattacatatgtggggctggacctggtgctggatatgaaggtggcggtgaaggagtattttcccaccggctctgtttcccgtatcaatagctattccaatgagattcagtgggactttactggcagcggcagggaatcctggtcggatggcatcgaccgtttcctgagagaagccaggaaaatggcgaagctggattccgtgccggccatcgtgcgggtccgggacgcttttcctgagaaccagaccgcctatattgtcatggactttgtggaaggagatacgttgaaaaactatctcctgggccatggcgtgctgcgctgtgaggagtgtatggcccttttatcccccatcctggacagcctggtggtgatccatgaccgggggttcatccatcgggatatttccccggacaacatcatgctccagccggacggcaccgcccggcttttggacatgggggcggcggtggatgtaaagaacagtaaaggccgggcctccatgcttgtgatcaagcggaatttcagtgcgccggagcagtacatggagtcggagactctggggagctggacggacgtgtacgctatgggggccaccatttactactgcctgacgggtaaggtggtgcccgaggcgctggagaggggagtcaggaacacgcacctttattatgacccggacctgaacattccgcggcatgtgaccattgccttaaatgacgctctgaagctccaggcagggtgccggatcagggatatgcgggagttcaaaaggagactgagcgggccggaggagcctgccggccagaaggatgatggcgcggaggtggaaatagccccggaacaggatcggattcacagaacagggcgtcgggggaagagaaacgcgcttatagctgtgggagcgttgtgcgtgctgtgtgtcctggcggtcctgttttacgcgttccgggattcgggaagcgccgctggtttcgaggcggagagcacggcggtggcggaagccgggcagacaaacgttccggccggacagagggctgacgacgggggagccccggaagagaaaacggttgaagagccaaccgccgcccagaacgaacaggagacggcaggggcatcaaagtatgtggatgtggatgaggcagagctgatttaccaggagacgaaagaaggaaatggaatcatgctgagggagtatattggaaaggattcctatatcaggctgccggatgaagttgagggactgccggtattagagctgggagtgttcttttttagccaacatgaaacgctggaaggtgttgtgctgccggagaaagttgagtatttggggtggtttacgcttgccaaatgtacaaatctcaaagaggttgaactgcctaaggacctggaaacgatcggtgaaaactccttttccgaatgccccggcctgagacggatcgaattgccggaaggcttaaaaagcatccaggatcaggtgtttgaaggctctggccttgaggagattacaattccttccagcgtcgaattcctcgacgtggggtctgctattttacagattccgcaagtgaaaattgcagaaggcaatcagagatttaaaatgagggatggcctgatttacaaagatgggaatgagctggcggcagttccgcagtggatagaaggaaaatttgtgatatccccggaaataaacgccattggcgggaacgctttttacagaacttctctgactgaggttgaaatacctggttctgtccgcgttgttaaaccgaaggcattttcagagggacacagacttgagacggttaaactcggggagggagtggaggagctgggatatcactgctttgcaggctgcgaatcactccgtgagatcatgattcccagaagtgtaagaaccatcgattttaatgcatttaagggttgtgtcaatttaaaaaccgtcaccgtcagcaaagattgtcagattgacgaggatgcgtttgacccgggcgtggaaattaactattacgattgatcgggggtatgatcatgcagatgaccagatgtaccaggtgtatggaagagctggaggagggcgcccggatatgcccacactgcggttacgagcaggacgacggcagtcagccgcccaacgccctgaaacgcaataccatcctccacggcaggtattacattggaaatgtgatcggccggggcggttttggaatcacctatgtaggatttgacctggttctggaggccagggtggccgtgaaggagtattttccttcagatatggcttcccgcaccaacagctactccagccggattcagtggaattttacagaaaacggtgagaaaagctgggcggaaggaatcgagcgctttctgaaggaagcgcaaaagatggcaaagctggattctgtgccgtcgattgtgcgtgtccgggatgcgttcagtgataaccagaccgcttacattgtcatggattttgtggaggggattactctgaaacagcatgtccaggagtacggcgcgctgggatatgaggaatgtatgaaccttctcacgcccattctggacagcctggcggtgattcatagctatgggttgatccaccgtgatatttcaccggataacatcatgctccagacggacggacaggcaagacttctggatatgggggcggcagtggatgtgaggtctggcggcgggcgcgcctccatggcggtggccaagcagtatttcagcgcgccggagcagtacatggagtctgaggccctgggaagctggacggatgtgtatgccatggcagccaccatttactattgcatgacagggaaaacggttccggaggcactggaacggggaatcagaaaaacgccggtttcatttgacctgggtctgaatattccggctcatgtgcagaaggcgttgattcatgccctggaaatgaatgccggcgaccggattcgcgatatgcaggaattaaagaaggagctggaatcaactgggaagaatagggcggctgcaggcgattcgaaaaagaggctaaaaatcgttctgataaccgcagggatattatcattcctgctggttccggcgttaatgttccgctccacccacagcgctggcgtgccagtcacgaccgttgcggatcagacggacgaggcgtctgatccgctaccggaaaccactgaacaggaaacagttgccatatcgcaatatgacgaggtaaaggcctccgagctgttgtacaaaaggacggaggatgaacgtgggattgttctgacctattatgaggcggacgaagaggagccgtatattaaacttccggatgagatcgacgggttgccggtacttgaactggcggagaaactattcgaggaaaacagaacactggaaggggtgatactgccggatcatctggaaataattggagattacgccttttatctctgtacaaatttaaagtatctggagctgccggaaggcctgaggaaaattggaagttttgcattcagggcatcaggcctaaaagaactgcgcctcccgtctgcggtgaacgaaatggacggtacaattctatatggcatggagataaaaattgcagagaaaaatgatgcttatagaatggtggatggaattatttattcggccaacggcctcggactgattgcatttcccagtaccatagaaggcaggtatgaaatatcatcagaggttaaatccatcggcaagtatgcattttataatacatccctggcagacatcacgattccagggagtgttctgaaggttggggagcatgcgtttgatcatggggagaaacttgaaaaagtggtgatagaggagggaacgtatcttttaaatcattatgcttttttaggatgtaaatcgctcagcgacgtcacgattccaaaaagtgttatggtgattggcaagatggtatttacaggctgtgataacctggaatcggttacaatcaataaaaaatgcgctttgtatcctctatggtctctgccaggaatcgatgtgaaacgttatgattaattcggaggaccagatatgcagttgacgagatgtacgaaatgcatggggaaaatggaagagggggaaaggatctgcccgaactgcggctatgagaagaacagcggcagccagccgccaaatgctctgaggcgaggcaccattctccgaagccgttattacatcggaaatgtgatcggtcagggagggtttggcattacatatgtgggatgggacctgacgctggagatgaaggtggcggtcaaggagtatttcccttccggttccgcctcgcgcaccaatctctattccaatgagatccagtgggagttcaccgacagcggcgaggcggggtggtcggagggattggaacgctttttgaaggaagcaaggaagatggcgaagctggattctatccccgcggttgtgcgggtgtgggatgcgtttggtgaaaaccggacggcctatatcgtaatggactttgtggaggggatcacgctgaaaaagtatcttcaaacccacggtgtactggggtatgaggaatgtttgaaccttttgctgcctatactggacagtttggcagtgatacatgaccgcggattgatccatcgggacatttcaccggacaatatcatgattcagccggacggctccgccagactgctggacatgggcgcagcggtggacgtgagggccaatgacgggcttgcttccatggcggtcgtgaaacggaatttcagcgctccggaacagtacatggactctgaacggttgggaagctggacggatgtgtacgccatggcggcgaccatgaactactgcattaccggcagagtggttcccgaagccatggagcgggaacttaaaaaaacgtccctttattatgatccgggcctgaatcttccgctgcatttcaaggatgcgctgaacagcgcccttgcattgaaagcggaagagcgtatccgtgacatgggaacgttaaaagagcggctcactgattcgaatgggagtgtgggaaaacagggccgggatttgaaggggagaaggaaaattacactgatagcggtgggggcgctgtttgcagtgtgcgccctgacgattcttttttgcacgacccgcgtttcagaacgcgctgaaaatgccgttgcggaggcgacggacgggacagtggcagagatgtctgtccatccggctgagccggagtatctggacgtgagcctgtccgatctgtcctatgaaaaaacagaaggtgaaaagggcgtgatcctgacacgatatatgggggaggggaatgcctatataaagcttccggatgagatagacggacagcccgtgattgagttgggatcggggattttccgtgagaatgagactctggaggggattatacttccatcggggctggagacaataaaaggaagtgcgtttcagctctgcgtgaaccttagagagatggaacttccggaaggcttgagggatattgatggcagcgcatttgccggcgttggacttgaggaaatgaccataccttccaccgtggagacaatcagaaaaggcgcttatattttcaaggttcccagggtgaaaattgcggagggaaataagacatacacaatggtggacaacatgatctgcaaagacaacagcgagctgacagcatttccgcccagccggaagggggaatttgtgattccgccggaaatcagcgtgatcggcgactatgcatgcttcaacacatctctgacagcggtcacaattccggggagtgtgaggacggttggagcgaatgctttttccggggggaccgggctgcaaaaagttgtgatcgagaatggtgtgcatgaggtaaagggctggagcttttccgactgccgttccctcagcgaggtcatcataccagagagtgtaaaaattattggttactgggcatttgacgggtgcgacagtttggaatccgtcactgtaagccgggactgcaagatggaaaatggggcgtttggcgaagatgtggagatacattattacgactaacggagcctgacaatggttttccggttgacattttcccaccatctggttacaatacaacagacaacgaatttcccccggaaaaggagccctaacctatggaacgccacatcaatctcaacgaaatctccgacggcaaattatacaacctaaacgacatggtccgggcggactgcggggactgtaaagggtgctttgcctgctgcacgggcatgggcaggtccattgtgctggaccccctggatttctataacctgacggcaaatctgcattgcaggtttgaagagcttgtctccggtcccctggagctcaacgtggtggacggaatcattctgcccaatctgaaaatgagcgggccgggggagcgctgcgcctttctgaaccaggaggggcgctgttcgatccatcccttccggccgggattctgccggatattcccgctggggcggctgtacgagaaccgttcattttcctattttcttcaggtccacgagtgccggaaggagaaccgctccaaggtgaaggtgcgcaagtggatcgacacgccggatgtgggaactcatgagacgtatatcgcggattggcactattttctgaaggattcccaggaaatgctcaaggcctccgggaacgagaacctggcccggcagttcaatttgtatttgttaaattgcttttttgtgacgccgtaccgcgcgcaggaggatttttatccccagttttacgcccggctggcggaagcgaaacaacagatgctctgagcgcggcggatggtccgcgattaacataaaaaataaaatgcaggtgggcggaaacggcgtctgcctgcattttattgaatgtaatgggccgcaggcgcagcccgcgggcgattgctgaatgtaatgggccgcaggcgcagcccgcgggcgattgctgagtgtaatgggccgccggcgcagcctgtgggcgattgctgaatgtaatgggctgtaatcggctatttttgacgcgggttgagaaaagaacgattgtaaatcgatgagcacttcggtataatgaaattaacggatcaggagagaagtccgcggaggtgtccgcgggaggaatgaacaggaggattatgaaaaagattttcaatcgattggcagtgctggcggctgtgtcgctgctgggggcggtttcgggatgttccggccaaaaacagctgctggatccgtctgcccccacggttgtcacgctctggcacgcctacaacgcctacgccaaggtggagtttgataaatgcatcgaaacgttcaacgatacggtgggaaaagagaagggcattattgtggacgcctacggttacggggccagcgacgagctggatgaagccctgtacgggtcggcgaaccaggtgatcggctcggacccgctgccaaatttgttcaccgcgtaccccgacagcgcttaccgcctggatcagatcgcgccgctgatggatttgagaaactatttcagcgaggaggaactggcgaaataccggccggaatttttgcaggacggcatctgggaggaggacggggcccggaaaatgctgcccatcgccaagtccacggagcttttatttgtaaatgagacggagtattcccggtttgcccgtgccacaggggcggacccggcggagctttccacctgggaagggctggcaaaaactgcggaggcctacgatcagtggtcgggcggaaagccgttccttggtatgaactcgtacaacgattttgccctgttgtccgcggtacagctggggcgggagccctaccggacggaaaatggcagggtagtgttcgattacccccaggaggcggcgaaacgggtgtgggatgtttactatgtcccccatctgatgggctggtaccggagcgagaccttcaaccaggacggcatcaaaagcggaaatctggtggcctacatcggttcgtctgcgggcgcggggtattttcccgaggacgtgattgtgagcggagcggagagctatcccatcgagtgtaccgtgcgtacatacccgacctttgagggcagggaggagttgatgacccagcggggcgccaatctctgcgggttcgcctcggatgaggcccatgagtttgcggccgcggaatttatgaaatggtttaccgacccggagcagaacgccgcgtttgcggtgtccacggggtatattccggtggagcgggaggcgttttcctcccttccggagctgttaaagtatgtccgcccggaggacaacaacctggcggtggagaagagcgtggccgcggcatttgaggccatggagagtaaggaattttatgtcaagcggagttttgagaattcgtacagcgccaatcagctgtttggcgattcgctctcccaaaaggtgaacctggatctggaggagctgcgccttcgggtggagagcggcgagaaggaagaagctgttttggcggatttcctgggcgaggagaatttccgcagctggtatgccgggctgacggccaaaatgtccgaggtcctggccggggaggaacatgaagagtaaatccattgcgcagaagctggctctggcgtttattgtttccgccgtcctgcagagcatcgtcatgtgggctgtgctggtgacgggaggcgtgatccggcattcaaaagaaaattcatatgccattttcgcggaaaaggtcagcgggcaggcagataatctggaaaaccaaatgacctcggtctggacaaattttgagcactataccgtgcagatccgccagtattttaccgatgaggccattaaaggcggggacgccgccgggagcgtggatgagcttttggagggcatcgctccggtggtcctcgactccatgtactacaccaagaccacgggggcatttttgattttaaacgaggtggagccggggaccaacaatcacgcggccctgtatttcaggaatgccaatcccaaccgcacggacgtgaggaacgccagcacctacatgctgtacggtccctggaacgtggcgcagggactccaactggtgacggacgccaactggggttaccggctggacctggacgcaatcgacagcgatttttatgagaagcccttcagcaatgtgggtcttacggaggataccaagctgttgggatactggagcgagccctttcggcccgcgcccggcggggaggaagtgatcacctattccgtgccgctggacgacaaaaaaggcaatcccatcggcgtgttcggggtggagatatccattcaccatctctataaaaatcttccggcttcccagggatcgggccccgagtcctacggttatatcatcggcaccagggacggggaggacagtccgttgcgggtgtccgtgctgaacggggcgctgcagaagagcgtgttttcggagggagaaccgctggagctggatctggtggatgaggagaacggcatttgccgtctgaagggtaccggggaacagaaggagctgtacgccggcgtcaatgaaatgggaatgtactacaataatacgccgttttcaggggagaaatggtatctcatcggcctgatcgacggctccgagctgcttaagtctccgcagcagatcagcgcgattctggtgatttcctttttagtctccctgtttctggggactgtgctggccctggtgatcagccggtggtttaccaaatattcacgtctaatggaactttcggaggttccggtgggtgtctttgagatgagccggcacaacaaccgggtgctgatgaccatgcaggtcccgcggcttttgcggctgagccgggagcaggagcgcagattcgcccgggaccgggacgcgttttgcgattacctgcacagactgtacgaacagtcggaaaatgaggagggaacgctgctgctcgacggctgcggccaggagtcctggatccggatcagccggaaagagcgaaacggggttacggtcggggtgatcgaggacgtgacggaggagacgcgccagaagaagatgctggaggtggagcgggactgcgacggtatgaccggagtcaagaaccgtatggcctttgagcgggagaccgcggctttcaatgaggagctggaggccgggaaatctctgtgtatggtgatgtgcgatttaaacggcttaaagcaggccaacgaccggttcggccacaatacgggcgacgagtacatccgctatgctgcggcggccatccgcaaggtgtttgcgcggggggagatataccgcatcggcggcgacgagtttgtggtgctgctggttgaccgcctgccggatgaggtccggggtgaggtggcggcgctgaagcgggagatgaagcatttcggccattatgcggggttcaagccgggaatctcagtgggatatgcgttttacgacgcggagacggaccggagcctgagcgatgtgctggaccgtgcggatcaggccatgtataaggataaatatcacaaggagcagtagacggccgcgccgggagacagaaccctctgtttcccggcgctttttgcaatgtgtttcggggaatcgtgacaaatgtcaccggcgcttgttacgcatggcctctgcccctggggacgaaaatgccgtataatgaaaacagaaagagacaacggacaagaggcgaaacaggaggatgggtatgacgattgtgattctgcttttattatatttggcgctgccgtttgcagagctggccgcgatcatcgtgctggccgtgctgaacgggcagaaaaagagaaggattgacgagctgaaccgggagctggccgcgatacgggccgaggcggtgtggcggccggagaatgcacccgtatcgtccgaagcagaacgcggttttgcggtcccacgggattccggggattggctgaattcgccgtccgcgccggattgggtagaaacggaaagggccgctcaggcgcctattcaacccgacacgcctcccgctccggcgccgatccggccggatattccccccgccatccggcaggggacggtggcgctggtagtgggcgtggtgtttgtgatcctggcgggcctgatttttgcaaccacggcgtggcggatcttgccggacctgttcaaggtggttctggtaatggcgttttcagggatctttttcggggccagcgccatcgcggaccatcgcctgcacatccgtgcaacctcgaaggcgttctacatactgggcagcatcttcctgtttgtggcggttctggcagtgggattcttccggctttttggcccggagttttcgctcaccggccgtcaccggtacctgctgcttctggctggcacggtgtttacggagttggcgctgtttgcggggcttagaaaatttacggaaaccgtctacgcgggctgctgtttgtccggtctcaccgtggcggccgcgcttttgaccgcctccttccaccccggccgtccggggttcgccctgggtttggcctgctacggcctgcttgtgacgggggccgcgcaattcctcatgtgcaggaaaacagaatcggcattgcccggcatcctgcgcatattccccatgttcgcaaccatcaatctgtggggaatcagcgccctggtgctgatcgtgttgggcacgggggttaccaccgcggcggcggccttcctgatggcaggcgttcacctcttcctgggtctgggcctcggccgaaacggcggggactccggggaaatgtgtcaggcatatcttgcaatgttttccgtacagcttctggcgggcctgtggcggcttgttgcgccggagactgcggcggctgggctttacaccgtggcggccggtttggtgatcctggccctgctggagcgcggaccggtgaacagcgtcgcccgggaagcgctgcggcttatgggcggagtggcgggtctgctgctgttttgcgggatactgctggccggaatcgcggacggcggtctgacggcccacggcttcatctgtatgggcctgctgaccctggacatcacgctggaagccctgaagttccgcaatgaggcattgaacggcctgcacagcctgatgacggctgcgtttctgaactacggtatcttttacctgccgctgagtttaaaccggcatctgctcatcgcggccctggtattctccgggctgtatctgctcgggcggcggatcaaatatccgctggcaagcccggccggggagcttttgtttaccgttctggcctttggggacgccgcgctgctctttacccgggctgtgatgggggccggcagcggcagccgttatctcatggcggcggcggccgttctggctttctcggccacagtggaatcctggacccggcgggtagagccgctgcgccaggcgcttccgctggcggcgctggggcttccggtcctggcggtctccatattggaagttaatctgggaatatttggaatcggctgcgaggaactgtttctggcttatctgatgatttttatggtctgggatatcctgaagcgcgaccgcatgcagatcggacttggggttctgggagcgtgcctgggagcggcgtattttttgatccattatttccgggggcaggcggttgcgcagccgttctacctggtatcagccgcttacctggttgtccgcagccggggacaggagcagagggcgcgcgccatatccgtttacggagcatgggttctggcgcttgccggggttcatacggcctgttatccgtatctggcgctttccgtgcagaggcggcttgtggttctggcggtgttggccgcagaatatctgctgctgcgcatgagaaaaccggcgcaggaaatggaaggctttttccaaatcgggtttgctgtgatttacatcgcggtgatgctgggattctaccggggcacggggccggagctggcctgtctgcccgtctgcctggcagccttcgcggcaatgtatgtcctgacctaccgtacgggcggtctgaacctgcatcttctgaccgcagccgtgacgctctggctgccggcggcgctgattggccgctatcagatcggggaagaacgcgtatatggggcgacactggcctttctgctggttttcggcgggctgctgcgggcaaagtggcggatactggagccggatgagaggcaaaagccgggcgtgcgagcggattggttctgcgtactggccgcccctgccctgctggtgatggcaatcgcggctcccggacgggaatggcgttttgcctgtattctggcggggatcgcctgcgccttgcagtacgcggcgctaaaacccctgcgccgggccgcgtttaccgccgccggagcgctggcggtgctggccttttgggcgcagccctttatcacatggccggagcttgtccgcctggaaatttccctgatccccgccgcggtctatatccggagtctggaggccgtctggggaaaaagccggtggatgtacaatctgcagacggccctgtacggcctctgtctgctggcgctgacccttgacgcctttgccaccaaccggctggcggacgcgctgatcctggaagggatttgcctggcggtgctggtgccgtcctgcgcagggaaatgccgccggtgggcgttcatttccgggggaacggccctgggcgtggcgctgtatgtgacgagaagcttctggctcagtatatcatggtgggtttacctgctggccgcaggcataggtctgatcctgtttgcagcccgaaatgaaatgaaaaagcgatagcatttgctttgacagaaactgtagacatatcgtataatcagggtacgggcaggacggctgcgctctgtccgactctttgaaggcggtaaaccgcggagaggactgcgccattgccggaatccggcaggacgcgggcgctgcttcgtccatgccgccgagggagaaccaatatgtttgatatcctgctcaatgttacatatctggcggccatcgccatgtccctttactccgcggtctggctgctgttgaaagcggaccggaaccggacggtctgcgcgttcatcgcctgccagctgctcatcgtggtctggtgcgtgccccagctgtttctggggtttgtacagtcccgggaggggctttacacggcctacgcggtttcctacgtgggcatctgttttatcggtccggcgtggctggtgttcgctctttggtacgggggaaaacccatgcccctctgggggatggcgctgatctgggccttgcccgcggtcaattacgccgtgttgctgaccaatgagatccaccacctgttctacgctgagttcgaggtgggaaatgtggtctacggcccggcgtttatgctgcacgtgctatttacctacgcctgcgtggtggcgggaatggccgcggtggccggaaatttccgcagataccgggtgcgcgccctgcacattgccatgattctggtctccgcggccgtgccgctgttgtttaacctgctgcacatttccggggcggttcagaccggctttgacctgacgcctcctgccttttccgtgtccagcctgattatgcttctggcggtgtaccggtacgatttcctggacgtgaactccctggctttcgggcagattctggcggagctgccggaggcggtgctggtttacaatgagcgcggccgcatcacctgcgccaacgcggtggcgaaggcctggttcggggtggaaaacggagatgagatggccgcgttcgaggaggcggtgcgcgggatggagcggctggaggagtcgccggacgccgctgccgcatccatggagcaggagcagcgttttctggtccggtccggggagcgcaggctggagatccgccgcaggagcaggcgggaccggagcgggcgttttcaggcggggacggtgctggccatggatgtgagccggtactatgagctgttggagcgggagcgggagctggcggtccagggggagcgcctggccgtggagcaggagcgcaaccggatcgcccaggaggtccacgacaccacgggccacaccctgaccatgatcaattccctgctcaagctggtccgcatcggccggaaggacggggccggggagcaggcggagtcggaggcttacctgatccaggcagaagaactggcggccggaggaatccgggagctgcgctgttccatcaacaatctgcgggcaatgggcgccgacggcctggtgtcccagggggtgcgccgcctggcggagagcatccgggagttcgaggtggaggtgacggttcaggggacggacagcccccgctacagccatctgtgcccggtcattctcccaagctttaaggaagcgctgaccaactgcatgaaatacgcggccgcgacccacgtggacgcgatcctgaaattttccggcgactgcctggcattttatatttttgacaacggccggggttgcgggcagattcaccggggcaacggcctggcggggatttaccgccgggtggaggctgcgggcggacaggtgagggtggcgtcggaggagggagcgggatttggaattacgatccggctgcccgtggaaccggaggggaaaacgctatgataaaggtggtaattgcggacgatatacagatcctgcgccaggggttaaaagccatcctggagcaggatggggatatagaggttacgggcctggccggagacggccttcaggcctttttgctgtgtaaggagaaaaaaccggacgtggcgctcatggacatgcgcatgccggagtacgacggggcttacgcaatccggcggatcaaggaggagctgcccggggtgaagatcctggtgctgaccacctttgacgaccgggagaccgtggacgcggctctggaaaacggcgcggacgggtacattttaaaggaaatgggggacgacgcggtgatccggtcggtgaaagccgtgtgcaccggcgtgcgggtgttcggggacagcgtgttccgttccctgcgggaaaccgcatcggctaagccggaaccgggtccgggggcgttcaacctgacggaccgggagcgggatatcgtgcgcctggtggcccagggaatggacaaccgggagatcgcccggaccctttacctggcggagggtacggtgcgcaacaacctgtcgcgggttctggaaaagctggagcttaaggaccggacccagctggcggtgtttgcggttaaaaataatttggattagaggcaatgagatgaaatggtttgagaagcatccgatgagtatgattgtggtggggattctgggagtctccctctcggcaatatttgtaaaatattcccaggccccttcggtggtgacggccgcctaccggctgttgtggaccgtggcgctgatgctgcccatggtgtttgggagccggaacttccgcagggaactggcggcggcggaccggcggaccgtggttctgtgcgcggtcagcgggattttcctggccctgcatttcacggcgtggtttgagtccctgaaccagacgtcggtggccagctccacggcgattgtgtgcacggaggtgatctgggtggccgtgggatttctggcggtgctgggaggccggattccgaaaatggcggctgccagcatcgcggtcaccgtggcgggcagcctgatgatcgctctgtcggattactccgccggggggaaccacctgtggggcgacgccctggccctggcggctgccatgttctctgcggtgtacaccctgatcgggcggcaggtccggcgggggatgagcaccacggtttacacctttatcgtctatgtattctgcgcgctttccctgtgcggggcgacgtttttttccggacagagcctgaccgggcacgggatgagctccgtgatggtgggactgctgttggcggtgttttccaccttactggggcacagtattttcagctggtgcctgaaatatttttcgccctcttttgtctcggcctccaaactgtgcgagccggtggcggcctccctgttcgccgtgctgctgtttggggaaatcccggccgggcttcaggtggcgggcggtctggtgacagtgggcggcgtgctcctgtactcccgggtggagtccggggaggcgggccggcgggccgcggggaaagaggcggccagggcctgagcggatacaaatatatcaatatagaaagagggataaaggaatggcaaaggtgataacacttggtgagacgatggtgtgcttttcgccggattcggccgcgccgctgcgctatgtgagcagctttcacccgcggatcgccggggctgagagcaacctggcggtgggactggccaagctggggcacgaggtgctgtggatcagccggctgggggaggacgagttcggtcactacgttcagaacatgatccgttccgagggcgtggacacccgggcggtacgttttgacgagtccaaccccacggggatcatgttcaaggagaccagccggggagagacggcggtttactattaccggaaacactccgcggccagcgccatggagccggaggacctggatgaaagcctgtttgatgaggccgaaattctgcacatcacggggattacgccggtattgtcggagagctgccgccggaccgtggagcgcgcggtggaactggcaaaacgccatggggtgaggatcagcttcgacccgaacatccgccgcaagctctggggggatcgggattacgcgcctatgctgagggatttttgccgggagagccagatcctgctcatgggactggacgaggcgaaggttctgtacggcggggagagcccggaggaaatctttgcggccgtgtacggggacggagcggcccagctggcggttttaaaggacggcggaaacggcgcgtgggcctccgacgggaagcagattctgtatctggagccctggccctgccggccggtggaccccatcggggcgggagacgcctttaacgccgcgtttctggccggggtattggagggacaggaccttcagacctgcggacgcatgggcgcggtggccggggccatggccacggagacggacggggacacggaagggtacccggaccggagaaagctgcagcggattctggagaaccgcgcgcagatttaccgttagaatctgaaaatggagtttacggcgaaagccgtttgctgtggaagaaaggagaaaagaaatttatggatatgcgggaagtatttgcacagcgcccggtgctggcgatcatgcggaacgtgcctcttgaggacactctttactatgccggggccgtggtggccggtggggtgaagatttttgaggtggcgctgaactcggtacatggatatgagcagatcgccatactgcgaaaggaattcggagaggacgtgatgatcggcgcgggcacggcgattaccccggaacgggccgaaaaggccctggaggccggagccggatttttgctgaccccgtccacacaggcggagatgctggagtggtgccgggagcggaaggtgccgtttctgccgggggcgctgacgccctccgacgtggctatgtgcgtgaaccacggctatcacaccatgaagctgttcccggccggagatatgccaatgtcctatatcaagagcctgaaaggcccctttgacgatacggagtacgtggccatcggcggcgtgagcgcggacaacattgaagagtttttccgccggggctatctgggcgcgggcctgggcagcaatattatgccaaaggaagcggttaaggctaaggactggaaagcctgcgccgcctatgtggcggagctggtgaaacgggccaacgcgggcatcgcggcttacaagggttgagcgccggcggcggaagcaaggcagcagggctgtgcacgagcgggcagaatgactgcggccatgcaggggcaggtcagccgcgcccttcacagggccagactgctctgaaattgtcaaaaggagaaggaaaaatcgatgaagatcaaggcagtgaacacatatctggtgcgcccccgttggggatttgtggaaatttgtacggacgacggcctgtgcggctggggcgaggccgtgctggagggccatgcggccacggtgcaggcctgcgtggaggagatgcgcgagtacctgatcggggccgatcccagacggatcgaggacatctggaccactctgtaccgggccggattttaccggggcggcggggtgctgatgagcgccatcgcgggcatcgaccaggcgctgtgggatatcaagggcaaatattttaacgcgccggtgtacgagctgatgggcggagcctgccgtgaccgcatgcgggtttacagctgggtgggcggcgaccgtcccacggacgtgggcgcggcggcaaaggagcgaaaggacgccgggttcacagcggtgaagatgaacgcaaccgaggaattgcagtacatcgacagctacgagaaggtggaccaggtgttggagcgggtggccgccatccgggagtcctgcggcaaatatttcggcatcgcggtggatttccacggccgggtgcacaggcccatggccaaggtgctggcgaagaagctggaggagttcgatcccatgttcctggaggagccggtgctctgcgagcacatggagttgtttaaggagatcgcggactgctgcaacattcccatcgccaccggcgagcgcctgtttacaaaatatgatttcaagcgcctgtttgccagcggcggagtggatattatccagcccgacctttcccacgcgggcggaatcaccgaggtgaagaagatcgcggccatggccgaagcccacgacgtggctctggctccccactgtcccttaggtcccattgccctcgcctcctgtttgcaggtggacgctgccagctacaacgcagtgatccaggagcagagtatgggcatccactataatgtgggcaagtccgttctggactatgtgaagaacaaggaggacttcgcgttcgtggacggctacgtccggctgccggtaaagcccggtatcggcgtggaggtcaaccgggagctggtgctggaggaaaaccgcacgccccacagctggaaaaatcccgtgtggcgccaccgggacggctccattgcggagtggtgacggggcccggtacctggaagcgcggcgctgtcgtttggcggcgtcctttggcgttcttcggcgtcattactccggcggcacgctggccactggcgaattttgtcaaaaaatgcttgaataatccgcaaaccagtgtataatagagttcgtaaaatcgaaaagcggggagctcacagtagtgggctgagaggaagctgagactgcttcgacccttgacctgatttggataatgccaacgtagggaaccatagccatttgtatcatatcgctgtgatgctgcctttcattggttgcatcgcagcttttttattggatgcaatggaccaatggaccgctggcgcggctgaagagaaagaggaggaaacacaatgtttaaaacctgtctggaaaatgtgaggaactcggtgcccctgattcacaatatcaccaactacgtcacggtcaacgacgtggcaaatgtgctgttagcctgcggcgcaagccccattatggccgacgacgagggggaggtggaggagatcaccgccatctgcagcggtctcaacatcaacatcggcaccctgaacagccgcaccatcccgtccatgctgaaggcggggaaagcggcgcaggccttgaaccatccggtggttctggacccggtgggagcgggggccagcgccctgcgcaccgaaacggccagaaggctgatcagggagatccggtttaccattgtccgcggcaatatgtccgagatcaagacgctggccgcgggcagcggcaacacccggggggtggacgccagcgtggaggacgtggtgacggaggagaatctggaatccgcaatcgcttttgtgaaggatctctccgccagggacgggtccatcgtggccgtgacgggggccattgacctggtggcggacgctaagcgctgttatgtgatccgcaacggccgcccggagatggggaaggtcaccggtaccggctgccagctgtccgcccttacggcggcctacgccgcggcaaatcccggcaactgcctggaggccgcggctgccgcggtctgcctgatggggctggccggggagatcggtttttcgcgcatggcgcccggggacggcaacgccgcttaccgcagccgcatgatcgacgcgatctataatatggacggccggaccctggaaaggggggcaaaatatgaggtgcgataaaaaagatttgctgttgtacgcggtgacggaccgcagctggttaaacggggccacgctgtatgagcaggtggaggcggccctgcggggaggagccacctttatccagctgcgggagaagacgctggaccaggagcggtttctggcggaggccagggagctaaaggcgctctgcaggcgctttggggtaccgtttctgatcaacgacaacgttgagatcgcagccgcggtggacgcagacggcgtccatgtgggccagagcgacatggaggccggagatgtgcgcgccaggcttggcgcggacaagattatcggcgtttccgcccaaacggtggaacaggcgctgctggcacaacagcggggcgcggactacctgggggtgggagctgtgtttcccaccggaaccaagcaggatgccacggatgtctcctatgagacgctgcgggacatctgccgtgcggtggacatcccggtgatcgccatcggcgggattggccgcggcaacgtggaacggctggcgggcagcggaatctgcggtgtggccgtggtcagcgccattttcgcccagaagcagatcgaagccgccaccgcggacttgaaagcggcggtggagcggatggtgaacccatgatcgccggggccattttcgatgcggacggcacgctgcttgactccatgcccatctgggacaacgctgcggccctatacctggagggattggggcatgtcccggagccggggcttgggagaattctctatcccatgtccatggccgagggggcggagtacctgatcgcacgctacggcctgacccagagccgggaggagatcgtttgcggcgtcagcgctgcgatcgaggacttttatttccaccgggcccagcccaaagccgggctggaggcgtttttgcggcagctgcaggagcgcgggattcccatggcggtcgccacctccagcgaccggcgtctggtggaggcagccttaaaacggctggggctgctgccgcggttcaacggcattttcacctgcgcccaggcgggggcgggcaaatccaggcccgacgtgtaccacctggcaaactgcagcctgggcggacccgatccgcagaccgtctgggtctttgaggatgcgttttttgccgcctccaccgccaggagcgcggggtatcgggtggccgtggtccgtgatccgtctgcggacggggaccgggaaaaactggaacagctggcggactacgccatggaggattttacggatttcaacggcttttaccaacaggccttgaaatagaacaacagaccggcggcagatcgggggcaccaccttctgtcgccaggagcgcagcggacatcggcgcgctctgacaaaattaatgcgaagggagaacaaaatgaacacagcattaacaatcgctggaagcgattccagcggaggcgccggcatccaggcagatatcaagaccatgaccgctcacggagtatacgccatgagcgcggtcacggccctgacggcccagaataccaccggcgtaacagggattatggaggtaactccggaatttttaagggaacagatcgacgatattttcacggatatctacccggatgcagttaaaatcggcatggtttcctccagccgtctgatcgaagtgatcgcggagcggctggcccattacggggccgcaaatattgtggtggacccggtgatggtggccaccagcggcgcccgtctcatcggcgaggaggccgtgggcacgctgaagcagaggctgctgcccatagcaacggtgctgacgcccaacatcccggaggcggaggtgctttccggcatggacgtgcgcacggcggaggacatggagcgggcggcggttttgatcggggatacatacggctgcgccgtgctggtcaaaggcggccatcagcttaacgatgccaacgacctgctgtaccgcaacggccgtttcaaatggttcctgggaacacgcatccacaatcccaacacccacggaaccggctgcaccctgtccagcgccatcgcttccaacctggccaagggccgggatatggaaacgtcggtggagatggccaagcgctatctgtccctggcgctctccgatatgctggatttgggcaagggcagcggtcccatgaaccacgctttcgccatccgtggcgagtattgagggggaggggactatgagcggaacgagaaagggaacttccatattaaacaacggcctgatctggtttggagccggcgtgtccattgcggaaatcctcacgggcacctacctggcccctttgggcatggcgaagggtctggcggccattctgctgggccacgtgatcggctgcagcctgctgtttctggccggactcatcggcggcttcgcccggcgcagcgccatggagacggtgaaaatgagtttcggccgtaagggcagcctgctgttttccaccttaaacgtgcttcagctgctgggctggaccgccatcatgatctacgacggcgctctggcggccgggggcgtgctgggggccgggcagacggtttggtgtctggtgatcggcggtctgatcctggtctggattctgatcgggatccggaacctggggaaaataaacacagtggccatggctgcgctgtttattttaacgctgattctgtgtaaggtgatcttttttggccgcggcgggggagttttggccggagacggggagaccatgagctttggggctgccgtggagctgtccgttgccatgcccctgtcctggctgcccctgatcagcgactataccagggaggccgagaagcccctggccgccaccgcggccagcgccgtgatctacggcctggtgagcgtctggatgtacgtgatcggcatgggcgcggcgatttataccggcgtgacggatatttcccagattatggtaaaggcagggctgggcatggcgggactgctgatcattatcctgtccaccgtgaccaccacctttttggacgcctactccgcaggcgtgtccagcgtgtccatctccggaaccatccgcgaaaaatgggctgcggtggcggtgaccgtgatcggaacggccgcggctatcgtctaccccatggacaatatcacggatttcctctatctgatcgggtccgtgttcgcgcctatgatcgccattcagatcgcggattatttcttcctgaaggcggaccgcagcggactcagctaccatgtgcccaacctggtgatctgggttctgggctttgcggcctaccggctgctcatgcaggtggacaccccggtgggcaatacgctgccggatatggcggtcaccattgggatgtgcctggcgtatcattggcttttgaagccgcggttggccgcggcgggggctgagagctgaggcagcccatgaactgagctagcggcccgttttctcaaacaccgccacataccggtccactcgtccggtttcctcatagccgtccttttccagctgttccagggtctgatccagattcttctcgtagtttgcccgcagatccaccaccgcgtacccggcctcatggccgctgtccagcaggtaaatttcatcccgcatggagagctgtggcacgaaaaaggtggaggagcggaccggcgcatcctccgggatttgggctaaaagttcccgggcctgggccgctttctcgtgatagcgcccgtaaagccggatgtatttggatttggaggacaccaccgtggcggtgatgaccagagcgcagaggaggcccgaggcgagaaggcgggatgtcagcgcccgccgccaaagcccggtccggtttaaactgcgcagattgatcattgccaggtagaagagtaaggccccgctgccgtaggtatactgaaaaaaaatggaatgctgatacttgtaattggacatcaggttgatcagcacaaaggggatgagcagcgtcaggcgctgccactgtctcgtcatcaggggcagaaatcccaggggcagcagcatttccagaaagaaaagaatcttgtcctccaccgcgatctgggaaagcacataggccgggtttaccaggatggttttgaacatgctggcaagccccaggcgcttgtctgagatgtagttgtcgaagcggttgatcatggccccgtccccgaagcggttgatataccacacggccatgacaaagtacaggcaggaggcggcaaacaccagcccgcccagccggtattcccgtttccccaaaaacaggtaaagtccgatgcatgccgcgtacacgggcgcgtcctccttcaccagcagcaggagcgccaggcaggccagcatggacttgaaacgccgtgtttccataaagtacagaacccagagaatgatcagggtcaaaaacttgttctcgtggaaatcgtaaaagcagccgcccataaacgcggggtaggcgcagtagaccagtccgaagcacagaatctgcgggcgggtgcattttaaagcccgggccagcaggcacagggggatcagcccgctgatcaccagaagtgcttgcagcaccaacagggtttccggcctgggaaccagtttgtaaaagggcagcagggcatagaaaatcggggacaaatgcacggcaaaatgggacaaaagtccgtcccgctccaccgtggtcaggggctggaggcatttgtccagataataatacatttgggaaaaaattccaaaatcataggccggggaataattcagccggtagcgcagcactgtcatgccggctgtaaacgaaaaccagagaaaggctgccgcgccgagcagaacccacagcctccgcccggcggtcagcctctccagccgggccctcatagcgccagagcccccttgatcatcagggccgccgcgtacatcgccacgctgggggccaggggaaagcgcagccgtccggctcttccggacagaaccagcagaagggccaggcaggcgtagattccggcccagagcccgaaataattgcgcaatgaaatctgccgcacaaaatccagcgtgaaaatggcggagctgttcatgagaaggcacatggtgttggtcatgagccagctggcggccagaagccggaacagattgcgcccgttgtccttaaggcaacccaatacggtattcaacagcaacataaatcattcctcccttttatacacagtatactatccgcgctatcctcaaatgtaaagatggagggcgcaaccgtaagaaaaattaggagaatattaataaaaagtaacagttcagacggcgggaaaattggtacgaaaacccgcttacaagcaagcttgacgcggcttcccgcaccaattttcccgccgtctgaactgttacaataaaaacttgtcggtttatggaaaaatcataaagtgctttacgcactgcaaggggcagtggtacaatagtggctgcggcatgtgccgcaggagaagtattcactcagaatttaaaggaaaaggaatgatcggacatgagaaaattgacgtatgcattgttggcggccgcgctggccgtgacggttctggcgggctgcagccgtaaagcggaggcagagggttccacacagcaggccacatccgccgcccaggagaagcctgtcaaggccgacaaagagaaggagaccaaggcggaggatacggcaagcgccgaaaccaaggcggagtccgggaccgaggctgaaacccagcccacggagctggcaaccggccgtcaccacgtgaagatcgaggtcaaggactacggcaccatctccgtggagctgtatgcggacgaggcgcccatcagcgtcaccaactttttaaagctggccggcgagggcttctacgacgggctgaccttccaccgcatcatcaccggatttatgatccagggcggagatcccctgggcaccggaatgggcggatcggatgagatgatcaagggtgagttcgcggccaacggcgtggaaaatcccctgcagcacacccggggagccatctccatggcccggtcccagtacccggatagcgccagctcccagttctttatcgtgcaccaggacagccctcatctggacggccagtacgcggccttcggctatgtgaccgacggcatggacgtggtggacaagctctgcgaggacacgccggtgcaggacaacaacggctcggtggccaaggaggaccagccagtgattgaacgcatcgaagttgtggattaaaccgtaattttttgaattgattgtggataatgccggaggaaatgaatcctccggcatttattttctacttgccaaatccgtgggttcagagtaaatttagtatcggtcaacgaccggtaacggaaaccatacggaagcgaggaaaaaacaatggccaaaggcgcaggtgcccgggatatgaccgagggcagccccatgaagctgatctggggctttttcgtccccatggtgttcggtctgctgtttcagcagctctacaacatggcggatactataattgtgggcaaatgcctgggggtgcaggcgctggcggccgtgggcgccaccggctccatcaactttatgatcatcggcttctgcctgggcgtgtgcagcggcttcgccatcccggtagctcagaagttcggcgagaaaaatgacagcgccctgcggcggtttgtggccaacagcggctggctcgcggcaattttttccgtggtgatgacgtcggcggtctgcatgctctgccgggacattctgttgtggatggacactccggcggatattttcgacggggcgtaccgctatatttttgtgatctttttgggcatcccggcgacctacctctacaacctcttgtcctgcaccatccgttctcttggcgacagcactaccccgctgatctttctgctgttctcctccgtgctcaacgtggccctggacttttttaccatcctggtgctgaacatgggggtggccggggccgggtgggccaccatcaccgcacaggcggtgtccggcctgctgtgcctgctctacatgcgcaaaaagttcacgatcctgaaaatgcagggcgatgagtggaaaccccgcaaggattacatgaagatcctctgcggtatgggcattcccatgggcctgcagtattccatcacggccatcggaagcgtgattttacagaccgccgtgaattccctgggttccatggccgtggcggccgtcaccgcgggcagcaagatcgtcattttcctctgctgtcccttcgacgccctgggctccaccatcgccacctacgggggccagaacgtgggcgcgggcaagctggaccgaatcgccccgggcatgaaggcctgcctgtatctgggcatcgtctacgcggtggccgccctgggggtgctctacctgttcggcgaccagatcgccctcctgtttgtggaccgtggggagacagaactgctgcgcaatacgcggatgttcctgctggggaacggcctgctgttcatcccgctggtgttcgtcaacgtgatgcgttttctgatccagggcatgggtttttccaggttcgcgatcctggccggcgtctgcgagatgatcgcccgctcctttgtgggatttgtcctggtgcccaggttcggttacatcgcggtctgcttcgccagcccggtggcttgggtggcggcggatctattcctgattccagcctacggatatgtaatgaaacagctccggcggatgttcgccgggcggaatgcggatttggcataaaaaatgtccggtgaaaccagattctggtctcgccggactttttttgcgtttttatggcgttttatagggcagcgtccatctcgcttttgcgctcccagggaagcacgggctgcagccggtgctcgacggagaggtcacggcggttgtactgccggtggaagttgccgatgatccgttttaacaccatctcccccttctccgcggtcacggtgggcagaaggatgatgtactggctgacgctgtagcgggtgtagacgtcgctgcagcgcagggaattgcggattgcgccgtttaagtgttccatggctctgttcaggacgttcatcttcggaacctggccatccaggtcgcagagcgtcagcaggcacaggtagatggaatcgccggttcgctcgatggcccggcgctccagctggtacaaatcccggaataccggatattcgcagtagaacgcaccgctgctggcttcctcccgcagggcctcctggatggagtccagattggtgttgatcccctgctccttgttgcggatcgtcttgtagagctccttgaaatgttcggagggggagatggaaaactcattgtaaaacaggtccagggtgtggttgtagtgatcgaccgcctggctgatgtggttgtctttatataaggaataaaccaggtaatagtgaaactgctcgtcaaagggttcgatgccgatggcggtctggcacaccgacgtgatagccccgtagtcctcgcgctccatcaacagctcgatggttttgtaaaccaatttctggtagagggaatggtagtaggtgctgatggggatcacccaggactcatactccgacttggggagaaaatcgcctttgtagagatctaagcccttcatgcacatagccaaaagctggtccgggtccttaaccgctccgccggagcttaaaacctgattgcacacggactcgaactggtcgatgtccataaccgtgggaatgtcctgagtccaggcgtaggaaccgcgctgctggaccaacagcctctgaggcgggattcccaggggatcaaggagcttgcgggagcggaacatcagggtctttaaggctccgccggggttggcgcccgggtcgtccggccagatcgtctcaatcagctcgttgacgctgatgtcttttttctgaaaaacaaccaaatattccagaaggctccacggctttttggactggttgctgttgtcgttgatctctttgccgtccactgtgatggaaaaacctcccagcgttcttacatatatagtttgcggtgattcatgagcggacgtttccattttaatcggatctccttttatcattctgtcaatataaccagtatacctacggaatcgaaaaatgtccatataattttatgaaaagccggcgaattgtaaccggtttgtaaccggggtttgttatactgaacgtaaaatagaatctataatcgagcgaataggcttaattttacagaaaagcaggtgaatcgatgtctgtagcgagaacaggagcattgccgaattcatacaaattttacacaatcgcggtaaatcgttttgagaaccggaggctggagggactggtgtttcacgagagccgggaggacgcggttgttttcaaaagtctgacccagatggcgtgcgtgttgaaccgcatgttcgatgagaaccactatcccatgaagagcgtggaccagcgctgtttccggagaaagcagtcggaggaaggcggtgaggagaccgcgtttacaaccgcggaggtttccgggacccactgcggggagttagccaccttccggctgcatgtgaagtaccgctatcacgccacgtggcaggggagtatcacccatcgggagaccggcacggtgtatccgtttgagagcgttatgcagctgatgcgcattttcaaccgtgtgctcggacagcctcttgaagcgcccggcccgcttgggaagaagatgtgcgaattggcggtttgcaattatcagggcagcacctttgccggggaggtatcccatccggcggtgaaggaccggtttttctttgaaaatgagttccagctcctggaccatttggaactgatgctgggcgagcgcccggcggatgtaccggacgattcggtgatcacgccgcggcagggaagcgtctgccgggggaccatcggccccatgacgttcctggtgcgcgtactctttcgcaggaacaatacctggcagggtacggtctgctggaaggaaaagggcgagcaggccagtttccgcagctttttggagctgctgatcatggtggattcagcggtccgccgggcggattttcaaaaagagtccgggccggccggggaagtgacggcataaggaaaggaatttgacggaatgagagacaaactgcatcgcctggtgatcatcgtgctggttctgattttagtggtcagcggcgggatggtgttcagccagtggctggagaacaagcgggcacaggacgagtacaaccgtctggcgcagctggcgagccagacttccgaagaaccggagacaactgaggcgcagactgaagcccagacggaaccggagacggagccttacaagtcgcctatcgattttgaagccctttgggcggagaatccggacaccgtgggctggattaccatcgaggggaccaacatcaattatcccatcgtcaagggaacggacaacgacttttacctgaaccatgattttaacggccaggagaatatcgcgggttcgatttatctggattttgagagccagggcgatttcgacggccgcaacaatattatttacggccacaacatgaaaaacggctccatgtttaaggacgtggtgcggtataaggacgaggcgtattttaaggagcaccagttttttaccatctatacgccggagcgggagatccgcctgaaatcggtggcggcctactatggcgaagccaagcccattgtgcgcaagacgcggtttaagagccaggagtccttcgacgcctttgtgaaggaaatgttgtcgccctgcgcctatgcagagccggttcagtatccggccaggacgctgtatacgctggtgacctgcagctacgagatcaacgacgcccgtacctttctgtttgcagtggaggtggatgagaacgggaacgagattcctccggacgaagcgtttcaggagcgccagctggatttggttcggaagtacgccgaggagcgggccaaacaggagtctgcggcgcagagcaatccgtagttgtgaaaagtgacgtcaacacgtgatgagtattagttgacatttgtcgataattgtggtaatatgacgttgaaatcagggtggaattatatatgattccatcctgtttttgtcctgtttaacattggtgcggcgcagccgcagccaaatgttttttacacagctcttaattcgggcagttatgcccaaattttataaaccccttgcacccggcacggctgctggaattaagaggcgggatattcgtttggaatatcccgctttcgtcatgtccggggccggtgggattatgcatgtttaatcgaaaaatgttaaaattataacggtatgttttgggcttattttggcgtaacttgtatagtttttcggcagaaagaaccattctttccaggaattaatggaattttaacgtgcacaaatatgcaaaaatgcgaattggggtattggaaaataaccggaattatgctatactaggcgcgttaaagcgtgccctggcgggagtagattccggacacgctctgggcgccggtttcatttttcgatcaaatgcaggcccggcaggagagaaacttggtaccgtcccatggttgacgatggagtcatgccgattgtgaggcatggctttttagttgcaattccatttttttccatacgggcacagacaaagaggagagagtgttatgaaaatgaatgcgaagaaagtaatgagccttatgttagccgggcttctggccgcggcatccttaaccgcctgcggcggatcgtcctccggcgataccacgaccgctgcggcgaaggaagagaccacggcgggagagagcgcggctgccggggagagcaaagcggctgagagcgataccgccgctgcagctgaaaacggcgagaagaaagtgctgcgcgtggctatggagtgcgcttatgcgccctacaactggacccagcccgacgacgccaacggcgcggtacccatcgccgacagcaacgagtttgccaacggatacgacgtgatgatggctaaaaagatcagcgaggagttggggtacgatctggagatcgtgcgccttgactgggattccctgattccggccgtgaccacaggccaggtggactgcgtgatcgcgggccagagcatcacctccgcgcgccttcaggccgtggatttcagcgagccgtactattacgccaccatcgtgaccctgaccaagaaggacagcccctttgcggccgccaagagcgtggcggatttaaagggagccacctgcacctcccagcagagcaccatctggtatgacacctgcctgccccagatcgaggatgcgaacgtgctgtccgccaccgccaacgcgccggacatgctgatgtccttgaatgcgggcaagtgcgacatcgtcgtgaccgaccagcccaccggaaagggcgcgctgatcgcttacccggatttcgtgatgctggatttcggcggcgctgagggagacttccaggtgaccgacgaggagatcaacatcggaatctccatgaagaaggggaataccgagcttaagtccgccatcgacggcgttctgtccaagatgacaaaggacgactattctaaaataatggatgaagcgatcgcagttcagccgctggccaaccagtaaagcgcgccggatcgatcagttaaggagagaatgttatgccaacagattttttcggccgggtaatgctcgtattcagcaaatacggaatgtccatgctccagggcgcgttgatcagtatggagagcgctctggcgggcaccgtcatcggctgcctgatcgggtttgcagtgggtattgtccagaccatccacacggagaagggggacaaccccattaagaagggggttgtctgggccgtgaagctggtgctcaacgcctacgtggagtttttccgcggcacgcccatgatggcccaggctatgtttatctattacggtttatttccgctgctgaatatcaatatgaccatgctgaaggccgcgatttttatcctgtccatcaacacgggcgcctatatggccgagaccgtgcgcggcggtatcctttccattgaccccggtcagacggagggagccaagtccatcggcatgacccatgtgcagaccatgatttacgtgattctgccccaggccctgcgcaacatcatgcctcagatcggcaataacctgatcatcaacatcaaggacagctgcgtgctctccgtgatcggcctggccgagctgctgtacaagaccaaggcggccgcgggcgctctgtacatgaactttgagacctacaccatcaccatgatcatgtactttatcatgacctttacctgctcccgcatcctgcgccgtctggagaataaaatggacgggccggacaactacgatctggcgaccacggacaccctggcctacaccagcggtatgatccggttcccggatgagaagaaggaggagtcatgatgaagggcgagaaaattttagagatccggcatctgagcaagatgttcggcaagaatcccgtgcttcgggacatcgatttttccgtcagcagcggagacgtgacctgtatcatcggggcctccggctccggcaagtccaccttgctgcgctgcctcaacattctggagacgcccaccacgggcgagattctctaccacggggaggacatcgcggacggcaaggtcaacgcggcccagtaccgctcccgggtgggcatggtgttccagagctttaacctgttcaacaacatgaacgtgctggacaactgcatgatcggccagaccaaggtgctcaaaaagagcaaggaggaggccagaaaaaacgccatgtactacctggaaaaggtgggaatggccccctatatcaacgccaaacccaagcagctctcaggcggccagaagcagcggatcgccatcgccagggcgttagccatggagccggaattactgctctttgacgagccgacctcggccctggatccccagatggtgggcgaggtgctggaggttatgagaaagctggcgggcgagggcctgaccatgatcatcgtgacccatgagatggcctttgccagggacgtgtccacccgcgtggtgttcatggccgacggcgtgatctgtgaggacggaacgccgaaggatattttcgagaacccccagaatccgcagacaaaagagtttttggggcggtttatgcggggataaaatgaaatagttggaatggaggaacctctcccgggcggtgtgaacgctgccggggggaggtttttttgttgaatgcaatgggcaggcagcgcagaggcgcatgtcgatcgaaaagagcccggccctttgccgggccggactctcggaacccttggcctggtttatctggcctggtcctttggtttaaccgccttggtaatataaggatataaatcctcatacgcctcccgctcggcctcggattggggcagggacgggatcaggccggtacagtccatggtggaacaggcctgtacgtcaatgtcacagtcttctttgtggttcataccggatcacctcctgagtgtgtttcaaaaagccgcttcaatccgcatacttagtgtgcgcattggcggcttttattggtcaggaaattaccggggattcagggaattaccgggcattgagcgcggccgcgataaagccctgaaacagcgggtgaggccggttgggcctgctttttaactccgggtgagcctgggtggccataaaccagggatgggacgggatctcgatcatctccacgatgcggccgtccggggacaggccggagagctttaaaccgttgtccgtcaggattttccggtagtcgttgttcacctcgtagcggtgacggtggcgctcatggatggtctcggccccgtacagggagaaggctttggagtctttgtccagcacgcagggataggagcccaggcgcagggttccgccgatgtcctccacgccgttctggtcgggcatcagatggatcacgggatgggtggtggagggatttagctccacgctgtgggcatccgcaaggcccgctacatggcgggcgaactccacgatggccagctgcatgcccaggcacagcccgaggaagggaatctgctgctccctggcgtactggatggcgcagattttgccgtcgatgccccggtcgccgaagccgccgggcaccaggattccgctcacgtccccaaggagctcggccgcattttcacgggtgacggtctcggaatccacccacttgatgttcaccgcggcatgattggctacaccgccgtgctttagggcttccaccacggaaatataggcgtcgtggagctggatgtatttgcccaccagggcgacggtcacctgggatctggggtgtttccaggcgtcgatcatggacttccagtcctctaagtccggctcggggcattccagattcaggcattcacaggcgacctgggctagatgttctttttccatggcaagaggagcctcgtagaggacgtccacatccagattctggattacgtgagaggagggaacgttgcagaacagggcgattttgctgcggatattgtcgtctaaggggagttcggagcggcagaccaggatgtcgggctgaatgcccatgccttgaagatctttgacgctggcctgggtgggcttggttttcagctcgccggaggctttcagataggggatgagggtgacgtggatcatgcaggtatttcccggacctgcttcgcgctggaactggcggatggcttccagaaagggctggctttcgatgtcgcccacggttccgcccacctcgatgatggcgatttccgtctcctgagtggagtggttgcggtgaaaacggctcttgatctcgttggtgatatgggggatcacctggaccgtgccgcctccgaagccgccgcggcgctccttctgtaaaaccgtccagtaaaccttgccggtggtcacgttggagttcttcgtcaggctttcgtcgatgaagcgctcgtagtggcccagatccaggtcggtctcagcgccgtcgtcggtcacgaaaacctcgccgtgctggacgggattcatggtgccggggtcgatgttgatatagggatcgaacttctgcatggttaccctgtaaccgcgggccttcaagagacggcccagggacgcggccgtgatgcctttgccaaggccggaaaccactccgccggtgacaaacacgtatttaactggcataacataaacctccttcttcagatactatatagtgtgtcgtgtggggtaaaaaaataacccatatattatacaaccagtctttttataatgctaggagttttttcaaaatttttaagaaatttcattgttcttttcttgatttatggggagactgacactataatggtagagaatgggttttcgtggatatttcgcttagtatgacccattcagagggagatttacacatatggataataacaagaagacagacccgaacgcgccgaagacgaactggcagaccatatccatgctcgttgtggccgcgctcatcacgttcactctggtcacgtttatgcagaacatgattatggacaaaaagaccaaagagctgacgtataatgagtttgtatcgatgatcgacgagggtaaggtggagtccgtgagcatcggcaacaccaagatcaccctggttcccaagccgggaaacgccgattatccgcgggatttaaactactatgtggtgcggctgaacaacgatttcgattttgccccccgtctgctggaacacaacgtggatatcctggtggagtcccgggacaacagcgtgattctggctacggtgctgaactatgccattcccttcctgtttctggtattcctgatgaatttcaccatgcgccgcatgggcggaggcggaatcatgggcgtgggcaagagcaacgccaagatgtacgtgcagaaggagaccggcgtcacgtttaaggacgtggccggagaggacgaggccaaggagtccctgaccgagatcgtggacttcctgcacaaccccggaaagtacaccaagatcggcgccaagctgcccaagggcgcgctgctggtaggcccgcccggaaccggtaagacactgcttgccaaggcggtggccggagaggcccacgtgccgttttattccctgtccggttccgattttgtggagatgtttgtgggcgtgggcgcgtcccgtgtccgcgatctgttcaagaacgcggcggagaacgccccctgtattattttcatcgatgagatcgacgccatcggccgcagccgcgacagccgtatgggcggcaacgacgagcgggagcagaccttgaaccagctgctctccgagatggacggtttcgagtcctccaagggacttctggtgctggccgcaaccaaccggccggagattctggatcccgcgctgctgcgcccgggacgttttgaccgccgggtggtggtggaacggccggatttaaacggacgtatcaacattttgaaggtgcactccaaggacgtgctgctggatgactccgtggactttaaggagatcgccctggccacctcaggggccgtgggcgcggaccttgccaacatgatgaacgaggcggccatcaacgccgtcaagcacggtcgccatgcagtgtcccagaaggacctgttcgaggcggtggaagtagtgttagtgggtaaggagaagaaggaccggatcatgaaccaggaggagcggcgcatcgtctcctaccacgaggtgggccacgcgctggtcagcgccctgcagaagcactctgagccggtgcagaagatcaccatcgtgccccggaccatgggcgctctgggttacgtgatgaacgtgcccgaggaagaaaagtatctgaataccaagaaagagctggaagccatgctggtggaggctcttgcggggcgtgccgccgaggagctggtattcgacagcgtgaccacaggcgcgtccaacgatatcgagaaggccaccaacctggcccgggcgatgatcacccagtacggcatgtccgagaagttcggcctcatgggcctggagacccgggagaaccagtacctgtccggccgcaacgtgctcaactgcagcgaggccacggcgggcgagattgatcaggaggtgatgcggatcctgaaggagtcctacgaggaggccaagcgcctgctggctgagaaccgggacgctatggataagatcgcggagttcctgattgagaaggagaccatcaccggcaaggaattcatgaagattttccaccaggtgaaggggatcccggagccgccggaggaggaagaggacgattccgacggcaggaacggcggaaatggagccggcggcgcagccgcgggcgctctgccggagggaacggttccgggcggcgcagggcagccccaggacggcgggcagcttccgggcggtcagggctacgattcccagggctacggtcagccgggccagtggcagcagccgggtgaaaacggctggggccagcctcagggcggccaggggtacgatccccaggccggtcagggatacgccccccagggctacggccagcagggtcagtggcagcagccgggtgaaaacggttggggccagccccagggccagtggcagcagccggagcagaacggatggaatcagcccgaaagcggccgggagcagcagaaccagtggtcccagccgggcgccaacgactggagccgtccccagggcgagccggatccgaacggcgggtcccagacagaagcgggaacggaccccaacgggggaagccagccgtagacaatggtaaatcaaccgcagaccaaccggtgatttgcagcaggatttttgatgacagagcttaaacgtgggcttttgccccgggtcggagacggcccggggtgaaggcccgctttctgcatagaaggaaatgggcggccggaagccgccgcaaaaacaggagggaatggaaatgaaaatcattgacgcgcatctgcatttttgtccggggcgggagtatttcgacgggatcgccgtggccgcgggccatgagaatacagaggagcatctgcgggaagagtaccgcaggcttggcatcgttcacggcattgtgatgggaaacagaggactggactgccgggaacaccggtatccgaaggagctgcgctattgcgtggggatcgatacggaagagcttgagaaagggtatctgaaccgggaggagttggaccggatcgaggagaacctgcgcctggatacctgcgcggggatcaaactgtaccccggctacacgaacgtttacgtgtcggatcccatctatgacccggtgtacgagctggccgcgtcctataaaaagccggtggccatccacaccggggccaccgcaggcagcaacgccctgctcaaatacagccatccgctgaccctggacgaggccgcggtggcccacccggacgtgcagtttgtgatgtgccacatcggcaatccctttctcatggacgcggctgcggctctggagaaaaatgaaaatatggcagcggacctgtccgggctctgggagcagcggttggacgtggagaccttctgccgggagaagcgcgggtacgtggaggccctgcagacctggatcgagtatgtgaacaattatgacaaattcatgttcggcaccgactggccgctggtgaacctggaggattatattgggttcatcaagcgcttgattccggagaaggcgtgggagaaggtgttttacgggaacgcggtgaggatatacggggaaattccgtcccggtttacctgctgatcgtggcggtagtcagaaactggaaccttccgtcccggatcaccttgatgaaggccaggttcttgttggcatcgcctgtcccattgaatgcgatggtaccggtggcgccctcgatcaccaccgaggacagggcttcccggatagcggccggatcagtggaatccgcggcctcaatggcttttatggcggccaggtaggcgtcgtagcccagggctgagacagcggggatggcctcgtcctgcttctcggtccttaggtattcccggaagcctttgatgaacgcggcggcctcgtcgttggcgggctcggactcgtcgaaggcggcggttaacactacgccctcggcagctgcgcccgcctccccgactacggcggaattctcccaggtgtctccggccgcgatcactgcggtgatgcccagttcccgggcctgccggatgataagcggggcggcagtcagggaggagggcgcgaaaatgatgtccggattttgggcgtttatgttgtttaggatggcccggaaatctgtctggcctgcctggaattgttgctcgctgacgatctgcccgccaagaccggagaatgcctccttaaagtatccgcccaagccggaggaatagccgtctcctatctgcgtgatcacggccgcgcgcttggcgttattctggtaggcgtagtttgccatggctgtcccctggagggggtcgctgaagcagacgcggaagtagaagtcgtttccctctgtaacctgggggctggtgcaggagcagccgatggctgggattttgttctttgcgaacaccgccccggaggctatggaaaggtctgagccgtagcttcccaacaccacgctgaccggttcactggccagcttggtagcggcgtttatggcctcggcgcagtcggatttgttgtcggcctcgaccagctttacggcgtaggtttcaccgccgatggttacggtgggataaacctgattggcgtagcggatacccagcatttcctggaaaccggcggcgccgtttgcgccggtgagcggttcaatcacgccgatgcggatgaccggttcagctgtttttcgtccgccgcacccgaccagggcgccggccgtcaggcagaccgccagtgcggctgcggcaatgtttctcctgttcatcatttggattctccttttatctcgtgcgcaggtgcacagcgcacctgtgcgctcattctcttactgcatttccataatgaattctactttgtcattagccgctaggctgatgacaagagatacgtttccttaattatactttagcagaaataacggatatctcaagaacaagatgcgcttttctgcggcctgtccgcggtttgccctgttcttaaggcgggcttccgaccggtcgggacttgcggggcgttgagccgaactgccgtttgtacgcccgcagaaaggtggagtaattggaaaaaccggccgcatagcaggcggaggtggcattttcccgcccggagaggatcaactccctggcaaaggccaggcgtttctggttgatataattgccgatggtgcagccggtttcctggcggaacaggcgcatcatgtggtaggggcttaagcagcactccccggccagcaggccgatggacaattcctcacccagatggccgttgatgtaggagatcagaccggaaacccggtaatccatggcgccggtgtgcacgtaagcggtctgagcgtccagggcggcccggtttaggaatatgagaaattccagcaggaggatgcgggcgtagagagggcctgcaaattctcccggccggtccagggcgcgctccagggtttgcagcagggacagaagggcggtccggtcctccccgccgggccggatcacgctggaatgccggtactgggcagtgcgaaagcactggtccaggggatcggacagggaatactcctggagaaacgcgggggagaggtagaggatcacccgctcgtagggctgcccgttcttcacgtgggggcagtggatttccccgcggttcaccagcaccaggtcccccggttccggctcataggtccggccttccacgatgtagtccactgagccggagatgaggaccagaatcttgcagaagtcgtggtagtggggatcgaagtccctggggccgctgtccgtcaagtggaacagacggtagtccccggataaatagccctggcgcggggcggcagagccgttctcaatgtattttccgtattcaatatccatgtcccgtcacctccccactgtgtgaatgtccaccgtgctgcggcctgtcctgggctggcagcacggctttttcttacattatacgaggtatagagcaggatttgcaatatttttccgcataatccttatatatttttaaaatactgccggttataatggaagaaataggtcacagtttatcatcggtcggaggtaacgtacatgaaagcggttgtagaaaaatatcacggtttaggaaatgattatcttgtgtttgatcccaatcaaaataagctggagctgaatccgcataatgttgcgcttttgtgcaaccggaatttcggcgtgggcgcggacggggtgctggagggaccggtgctggagaacgaccggatctccatggtggtctggaacccggacggcagcatcgccgagaagagcggaaacggggtccgcattttcgcgaagtatttaaaggatgcgggttatgtgcagaaaaaggatttccatatccacaccgcgggcggtcaggtttccatccactacctgaacgaggagggcacccggctgaaggcgtctatggggaaggtgtccttctggagcgacgacgtgccggtggaggggccgagacgggagatcatcaacgagaccatggtgttcgggcgcatcccctacccggtcacctgcctgtccatcggcaatccccactgcgtgatcctgatggatgagatctcaaaggatctggtctgccgcatcggacgctattccgagagcgccaggcagtttccggaaaagatcaacacccagatcatgaaggtgctggaccgcacccacatccagaccgaggtctatgagcggggcgcgggttacaccctggcgtccggtagcggctgctgtgcggccgcggccgcggcttaccggctggggctgacggatcccaagatgctggtgcagatgcccggcggaaccatggagctggagatcgaagaggacggcacggtgctgctcaccggggacgtgggatttgtgggaaccatgaagctgggcagcacgtttgtggaacagcttcgctcgttcacgtaaaaaagtgcaggggtaacgcaggaaaacgcattgacaaataaaataactgctggtattcttgagaaaaagaataaaacgagatcatcattgcaaaggagcgaactgccggaatatccggcccgtgttgacggctgcatggtggtctcgtttcacttgtttcagacgagaaagggagaaaacaatgagcaaatacagtaaggaagatataatccgccttgcggaggaggaggatgtggaattcatccgtctgcagtttacggatatcttcggaatgctgaaaaatgtggccatcacgtccagccagcttcggaaagccctggacaaccgctgcatgttcgacggctccgccatcgagggctttgtgcggatcgacgagtccgacatgtacctgtatcccgacctggacacctttgagatattcccctggcggccccagcagggcaaggtggcgcgcttgatctgcgacgtgtacggcgtggatcaaaagccctttatcggggacccgcgttttgtgctgaagcgcgccatggagcgggcgaaggagatggggtacgtgttcaacgttggcccggagtgcgagtttttcctgttccacaccgacgaggagggccgtcccaccacccagacccacgagacggccgggtatttcgacgtggcgcccatcgacctggcggagaacgtgcgccgggacattgtgctgaatctggaggacatgggatttgaggtggaagcctcccaccatgagatcgccccggcccagcacgagatcgatttccagtacgagaacgtgctgcgctctgcggacaatatcatgaccttcaagatggcggccaagaccattgccaagcgccacggccttcacgccacctttatgcccaagcccaaggagggcgtcaacggctccggcatgcacatcaacatgtccctggaggacgccaccgggcgcaacgcctttgtggatgagagcgattccctgggcctcagcgccaccgcctactattttatggccggaatcctgcaccacatgaaggccatgacgattctgaccaacccgctggtgaactcctacaaacggctgatcccgggctatgacgcgcccatttacatcgcatggtccgccacctccaaccgcagctccctgatccgcatcccctcctccaagggcgccggaaccaggatcgagctgcgctgtccggactccgctatgaatccctatctggcattggccgcctgcctgcgggccggtctggacggcatcgagaagcagattaagctgccggagtgcgtgcagggcaacatgttcatcatggccccggaatgcctggaaaagcgcggtgtggagcggattcccgagactctgggcgacgccatcgaggcatttgagcacgacggctttatgcgggatgtgctgggcgaacacattttcatcaaatatctggaagccaagaagaaggaatggcgcgagttccgggcacaggtgacggactgggaagtgagcgaatatttatataaatattgacgcctgtgttctgacgcgggctccggggcggagtccccggagcaaaagggccggctgaccgggaggtgaggcatgtgacaaatataatcgtggcgttctccaagccggaggatgggaaaaatataaagggcatcctgatgcgcagcggatttcaggtggttgcggtctgtgcctcgggggcgcaggccatcacggcggccgagagcgtgaacagcgggattgtggtcagcggataccggtttgaggatatgatgtacgatgaactgcgccagtgtcttcctgccgctgtcgatatgcttctgatcgcctcccccagccggtggagcgggcagaacatgaagggcatgatctgtctgcccatgcccctgaaggtgcacgacctggtggacactctggagatgatggtgcagtcccaggcacgcatccgaaggaaacagcggctgcgccccaaggagcgcaattcggaggaacagaacctgatcatgagagccaaggagcttttgatggagcgcaacaatatgactgagtccgaggcccaccgctacatccagaagtgcagcatggacagcggtaccaacctggtggagacggcgcagatggtgatcagcctgatacatgtgtgaggagagggatatgagatttacaaaaatgcagggaatcggcaacgattacgtttatgtgaactgttttgaggagacggtggctgacccggccgctgtggcgcggtttgtcagcgaccggcatttcggcatcggctcagacggtctgattctgatcggtccgtctgagacggcagactgccgcatggatatgtacaatatggacggctcccgcggcgtgatgtgcggcaacggcgtgcgctgcgtgggcaagtatgcttttgaccacggcctggtgccacaggacaggagaagcctgacggtggagactctggccgggatcaagaccatcgagtttacggcggaggaggaaaacggccggctcgtcgcaagacgtttgaccgtggacatgggggaggccaggctgacctcggagcttcccgagccgatcaacgtggacgggagggattactcctttgtggggattagcgtgggcaatccccatgcggtgtactttatggattccatcgacgatctgaggctggaccggatcggtccctcctttgaaatgcatccgcgtttccagccggaccgggtgaacaccgagtttatccagctggtggaccggaaccatatccgaatgcgggtatgggagcggggcagcggggagacttgggcctgcggaaccggggccacggccagcgctgcggctgccattctcatgggctacacggaggacgaggtggaggtggagctgcggggcgggaagctgcgcatccgcctggaccgggagagcggccatctgtttatgaccgggcctgcggtggaagttttccgcggggatattgacattccggaaaatttataatatgataccacatatgaaattagtcgaaacaaactctcagggaccagcggcacgacggtgtgcggcaggttcctgggagtatttaattggaggcagccgctctggcgcggcctgagggccattgccggggcggtgtaccgtccggacagcatgtccggcgcagcgggacgcgccgcaagatattccaggaggtaagaagataatgtttacggtcaatgaaaactacttaaagctgccgggcagttacctgttttccgatatcgccaaaaaggtggcggcttaccggaaggcccacccggagcgcgagattatccgtctggggatcggggacgtgacacagcccattgccccggccgttgtggaagcgctgcaccgggcggtagacgagatgggggatgccggtacctttcacggatacgccccggatctggggtatgattttctccgggaagcgattgtggagaacgactacagggcctggggctgcgcggtggaggcggatgagatctttgtctccgacggggccaagagcgactgcggcaacatccaggagattttcgggccggactgccgcattgcggtgtgcgaccctgtgtacccggtctatgtggactccaacgtgatggcaggcagagccggggcgtacgatccggccaccgggaaatggagccgggtgatctacatgccctgcactgcggaaaacggctttgtgccggagctgccgaaggagcgcccggatctgatctacctctgcgtgcccaacaatcccaccggcaccgctctcacccgggaccagctggcggtgtgggtggactacgccaatgaaagcggcgcggtgatcctctacgatgcggcctacgaggcctatatcaccgaggaggacgtgccccacagcatctacgagatcagaggggccgggacctgcgccgtggagttccgctccttttccaagaaggccggtttcacgggcctgcggctgggcttcacggtggttccgaaggacttaaaacgcggcggtacggccttgcacgggctctgggccagacgccatggcactaaattcaacggcgcgccctacatcgtccagcgggcgggcgaggcggtgtactcggcggagggaaagcgccaggtggaggagcaggtggcctattatatggagaacgcgcgggtgatcctgcaggggcttaaggaagcgggctgcaccgtattcggcggcgtcaattccccctatatctggctgaaggtgccggagggcatgaccagctggcaattttttgatttcctgctggagaacgccaacgtggtgggtaccccgggcagcggcttcggacccagcggcgaagggtatttccggctcaccgctttcggcacggttgagaacaccgcgcgggcggtggagcgcatgcggaaggttttggggtgacccaaatcattttcttagaaaattaggttgacaagcgaataaaatcagtttatgataccaagtaagaaaattttataagattttttcgggcaaaagcgttcggaccagaggttcgggcgcttctctgcttattgggtgcgatgagccgccggcgctgtctgcgggccgctgcccggcaggccgccacggaaaacggagtttgggaggaattgagtgatggatgacattgaccgcaagatactgaagctgttgcaggcgaacgcccgcatgtccctaaagaccattgcggagaagacgtttctgtcctctccggccgtgtccgccagaattgagcggctggagaaggacgggatcatcgcgggctaccacgcgtttgtggaccccatgaagctgggctaccacattctggcctttatcaacctggacgtggtgccggaggacaaaccgaaattttacgcctacgccaacgacgtgcccaatgtattggagtgcaactgcgtcaccggcgagtattccatgctgatgaaggtggccttccagagcacgatggacctggatatctttatcggccagctgcaaaaattcggaaaaaccagcacgcagatcgtattttccacccaggtggggccgcggggcgtggatgtggatgaaatttagggcattccagtccatttaaaccgcaactttcggcgattcttcacatatggtataaggagagaatatttaattctccaaggtgaaatgtgaaggagtgaccgaaatggcagaaagaaagacggttattatagatgcaggccacggaggggcgaaccccggggccgtttacatgggacggcaggagaaggacgacgcgctgcgcctggcgctggcagtgggaaatctgctggagcagagcggcgtgaacgtgctctacaccagggtgaacgacgtgtttgacacgcccttagagaaggcgcagatgggcaatcagtccggtgcggattactttatctccatccaccgcaacgccatgccgattcccggcagcgcgtccggggcggaggtgctggtgtaccaggacgagggcgttccggctcttttggccgagaatatcagccggaacctgaccgaggccgggttcgcggacctgggggtcaaggagcggccgggcctgattgtgctgcgcagaacccagatgccggcggtgctggtggaggccggatttatcgacaatcccgaggataaccggttctttgacgacaattttgagaacatagcaaaggccatagcaaacggcgtgctggagacgatccggcagcagcagatggcgcggcctgagtattatcaggtgcaggtgggggcgtaccgggaccgggttccggcggaccggctgctaaaggagctggagtccaggggccttcccgccttcatcgtccacgacgacggctactacaaggtccgggtgggcgcgttcctcaacatggacaacgcggccaacatggagcgcatcctgcgcaacatgggatatcccacgcttatggtgcgggagcaggcggtgtattgactggcctggatcgtgcaggtttgaataaatggaatgaacaggtcggcaaatgggctgacgtctgccgccgcgggcgcttaaagcgttcgcggcctttcgggaatggatcgcaggacaagggataaaatgggcgggatgggggattttagtgatatggggaggtacgggagatggaatatttagaagcgttgctggcgatggtcgccaatggggcgattataatttttgagtttatgggcgtgggaattatcatttattccgggtttacaggttttatcaagtttctgcataaggcgcctgagacgaagatttatctcgccaagggccttgccatgggcctggaatttaaaatggggagcgaaattctccgcacagtggtggtgcgcgagtggaaggagatcggaattgtggcgggaattatcgcgttgcgggccgcactgacatttctgattcattgggagattaaggaggaggagaggagtagggagtagcgggggcgaatcaggcatgctgatcgcgccgaatgaatgagaacatggaggctgccgggaggcagaaaggaggcacatatgagcaggaattttccggaaaagctggatcggaaggtaatctatgagagcgattggatttcattgtacacggacagggtgcggatgccggacggggagataatcgagtcttaccaccggttgcattatcctcatgagtcggtttgtgtggtcatctgtaatgcgcgcgatgaatttttgctgatccggtcaaaacggtacaccacgggacggatcgagtgggagattccggccggccgggttgaggaaggcgaaagccctgttgaggcggccaaacgggaatgcttcgaggagacgggctgcgtgaccacggaccttaccttcctgtgtacccagaaccccagcaacgggatgtccgatctggcggtacacaattatttagggaaggtggagcgcgagaccgattgcttcgatgaaaatgaagtggacggaaagcagtggatcaagcgggaaacggttttggaaatgcttcggaaaaacgaaatcttttgcggcgcctccatgttggctctgatgtatgccattcagttttatatgccggaaaacagccggtgatattgaccggggcgggaattttccgacgcgctccaggttctgcgcgggatctgtgatatcgtataaacatttgacgaggtatttctttcacgagcttagtgcttatggtataatgaaagcagcagtacaaagcttgttgtcagcaggtgaaggcgcggaaaaccgcggaaggagggcgacgctatgaaggatggaagacggcttgttatcaccatcgggaggcagtttggcagcggcggacgggagatcggttcccggctggcggaggaactgggaattggcttttacgacaagaatattctccggatgaattccaatgagagcggaatcaaggagagctactaccatctggccgacgagcggccggggagcaggctgctgtacaagatcatcaagggagctgggagcaccttcctttggctcggatctggtttccgcggacaatctgttccgcttccagtccgaggtgatccgccagctggccgacggggaggactgcgtgatcatcgggcggtgcgcggactatgtgctggagggacgggacggcctggtgcgggtgttcctgtacgcggacctggattaccgggtcaaacggatcacggagctggggtactacgaggataaggacgttaagaagaacatcaagcgcatcgaccgggaacgccgggactaccaccggtattacaccggacgcgactgggaaaatgtggagaattatgatttgatgctcaacacggcccggctgggaacagagggcgcggtgagagcgatccgggagtaccttaagatcaaggggctggcggaggaatagaggttgagggagagcggctctgcgcagggagatgaaaatgcgcagagccgtttttcgttgaatgcaatgggtcgccgtcgtagcctgcgggcgattgtttcagaaaagccagatgcacggcaatggttgcgcgcagttacggtctgccgtgttgtttttcagccggaaaaaatgttttccagccccaaggcttgcaccctgtcctgcacttctgtgggtgaggtgagataaaggcccagctccttcatccgctcgaagagacagccgccggaaaaggtatatttccggcagaggccgtccggggtgcgcatctcctctccggtccaggcaatggcctcccctgaggccagggagcgtggaaggatgagcggcggttttccggaaatggctgcggcgcagttgtaaccggccagtgcgccggtgaccatcgcctccgtgtggcccaccaggggaccggccttttcacccgcgcagtagaggttggacagcccgtttaccttcaggtcatcgccgcgtgggcacatggcaagaaaacgtacggaatttccgttgccgccggcgtaggggtcctcatagcgggcgttttccaggccgggaatgcggcgcagcttgtcgagggggaagaagggcgccatcattttggcgtggccgctgtccagcagcaccagattttctgcaaactccggcaaagcgtactgctggcaggcttttaaggacagatggtcctcccgcagaccgggaggaagaggaataacggcggctccggtttcattcagctggcggacaaggtccggggcaagggaatccttcatcagcttgcaggaaccgctcatagctccaggagtaccgtccggccgccgggcctccagctcacggacgcctgccagagcggccaggctcacacggccgccaaagctgggacagcgcagaatgcacatggagcagccgtttccgtaacgggcgcagttggcggtgggaccggctgtgcccgttgcgtcgaggaacgcatcggcggcataggtatttccatggccgtcggtgacggactcaatggaggttttgtccgccgacatggagattccggtgatccgggtctgggtgcgcagcgtcacgccccagcgcttcagacagtccaggaccgcgccgggggccagggcgatgtcgtaaagatcggcgtggtcatggccggggaaggaaatgttccggtggcgcagggcgggttcaagggcattgagcaggtccgcgccgcccatggcctccagctccagagcggcggtcagccggccgttgtttcgcaggatgcctccgaccagcccggtgccaaggatcatatcggtccgttccaaaagtcttacccgggcgccttgtttggcggcggccaccgcggcggcgcagccggcccagccggcgcccacaattacaagatcagtcaagttgatatacctcctttttacggcctgacggctgcggggtgaaaggtctatgttagaatttatgcccgggacggcatttcatgcgcatcccgatgggatcggaggtggaaaatcgcgcgggactggcatgaaacggcggtgtgcgtattatattgtagtaatcataaaatacgaggtgttacatgccaaacaatgcggaatcaggctacaggggcctgcttcaggtaaatgtcgtcaatattcagaataattttcccattcaaaacgcacggattaccatcagctacaagggggatccccagtcgccggtggagcaggttgtgaccaacagttccggccagacggagcaggtggccctctcggcgccgccgttggagctgagtctggaaccgggggacgtccagccctactcggagtacaatctgcgggtggaggcggagggctttgatccgctggtggtgtcgggaacggaaatacttgcggattccaccgcgatccagccggtgagcatgacgccggtgggagaggtgccgccgccagaggatccggtggtgatcccggatcacacgttatatggaaattacccgccaaaaatcgcggagccggagatcaagcccgtggcggagagcggggagatcgtgctcagccgggtggtggtgccccagaccgtggtggtccacgacggagtacccacggaccggacggcgaaggactattatgtgccttaccgggattatattaagaacgtggcctccagcgagatctattccacctggcccagggccacgatcacggccaatgtgctggccattatgtcgtttacgctgaaccgggtgtacacggagtggtatcggaatcaggggtatgattttaccatcacctcgtccacggccttcgatcataagtggatctatggcaggaatatttttgagagcatttccctggtggtggatgagatttttgataattacttgtcgcggcctggggtgcggcagccgattttgacgcagtattgcgacgggcggcaggtgcagtgtccgaattggatgacccaatggggcagctgcgatctcggccaaagaggctacagccccattgagatactgcggtatttttatggggattcgatctatgtgaacactgcggagcagatttccgggattccggcgtcctggcccggatatgatttgaccgtggggagttcggggcccaaggtgcagcagatgcaggagcagctggataccatcgccacagtgtactcggcgattccccgcgtgaacccggatgggatttatggggagagaacggcggaagcggtcagggagttccagtcgatttttgggctgcctcagaccggagtggtgaattttgcgacatggtataaaatttcgcatatttatgtggggattaccaggattgcggagttggtatagaggatagtgggagaaggtacgcgccctatcatacatttgtatatgagtttatcttatatgaagtattcatatcctttattgtcgctgttatggctggtgtggtttgccacctcatcaacaaatggttagacggcgacaaatagccggtaacgggcctatggcctgagccgccatacaaaaaagggaatagaaaagccacgaggtcccgactcgtggcttttcgctgttccgaatggaatgtagccgtgacaggatttgacggtggggagttccagccgatcatcaaggtattctaataaatataattgagaatacttataaatagaatctctcccgtggggtttacataaatataaaaaatatttagtgatagacaaaaaaatttagcctttaaagccattgcaaattaatacgaaatacagtataatctttacaatttgggctgaaatagcggtaacgcttcagacagcccaatgcagacacgctatttgacgcaaaagaaaggacaggtaccccatatgaaagcatacctcatactggaagacggaactgtttttaccggaaccagcatcggttcgcagagggaagtgatcagcgagatcgtgtttaatacctctatgaccggttatctggaagtcctgacagacccgtcctatgcgggacaggcggtggtgatgacgtatccgttgattggaaattacggcatctgccacgaggacatggagtccaaaaggccctggcccgacggttatattgtaagagaattatccagaatccccagcaatttccgctgtgaggataccattcagcatttcttagaaaaatatgatattcccggtatctgtggtatcgatacaagagccctgacgaaattattaagagaaaaaggaaccatgaacggcatgatcaccaccaaggcgtatgccgattttgcggagcccatcagccggatgaaggggcattcggtggccggcgtggtgatgaaaaccaccaccagggaaacgtatgttctgcccggcgaaggcaagcgggtggcgcttatggattacggcgcgaaggataatatcgcccgttccctgaaccagaggggctgccaggtgacggtttacccggcggacacgcccgcggaggtggtgctggcggagaacccggacgggattatgctgagcaacggccccggggaccccaaggagaacgtggaaatcattcaggaaatcaagaagttgtatcagtccgacgtgccgatttttgctatctgcctgggacatcagctgatggcgctggctaacgggatggatacctataagctgaagtacggccaccggggcggaaatcatccggtgaaggacctggctaccgggcgggtgtatatttcctcacagaaccacggctacgtggtggacacggacaacctggacccgaagctggccgagcctgcgtttgtaaacgtgaacgacgggaccaacgaggggttaaagtacacgggcaagaatatttttacggtacagtatcacccggaggcctgcccgggcccactggattccggatacttatttgaccgtttccttaaaatgatggaggtgaagaactgatgcctaagaatcctgatatcaaaaaagttctggtactgggctccggtcccatcatcatcggccaggcggcggaattcgactacgccggtacccaggcctgccgctccttaaaggaggagggcgtcgaggttgtgctgctgaactccaacccggccaccattatgacggacaaagatatcgcggaccgcgtttacatcgagccgctgaccgtggaggtggtggaacagctgattttaaaggagaagccggacagcgtgctgcctaccctgggcggacaggccgggttgaacctggctatggagctggaggacgcgggttttctgaaggagcacaatgtgcgcctgatcggaaccacggccctgaccatcaagaaggccgaggaccgggaaatgttcaaggaaaccatggagaagatcggcgagccggtggccccctcggatattgtggaggatgtgaaacacggtcttgagatcgcggaacagatcggatatccggtggttttgcgcccggcctacaccctgggtggctccggcggcggcatcgctcagaatcccgagcagtgcgccgagatcctggagaacggcctgcgcctctcccgcgtgggacaggtgctggtggagcgctgcatcgcgggctggaaggagatcgagtacgaggtgatgcgcgacggcgcgggcaacgtgatcacggtctgcaacatggaaaatatcgacccggtgggcgtgcacaccggcgacagtatcgtggtagctccttcccagaccctgggcgacaaggaatatcagatgctgcggacctccgctttgaacattatcagcgagctggggattaccggcggctgcaacgtgcagtacgctttaaacccggacagctttgaatactgcgtcatcgaggtgaatccacgcgtgagccgttcctcggccctggcttccaaggcaacgggctaccccatcgccaaggtggcggctaagatcgccctgggttacaccctggacgagatcaaaaatgcggtgacgaaaaagacctacgccagctttgagcccatgctggactactgcgtggtgaaaatgccccggctgccctttgacaagttcataagcgccaagcgcgccctgggcacccagatgaaggccaccggcgaggtgatgagcatctgcaccaactttgagggcggcctgatgaaggccatccgctccctggagcagcacgtggactgcctcctgtcctacgatttcacggatcttgacgacggcagcctgcgggaggagttaagccgcgtggacgacatgcggatctggcggatcgccgaggctctgcgccgcggtttcacctacgaggagattcacgggatcaccagaatcgacgtgtggtttatcgacaagctggcgattcttgtggagatggaaaatgagctaaaggcagtgggccggggcgagaaggagctgaccacggagcttttggccgaggccaagcgcatcgagttcccggacaacgtgatcgcgcgcctgaccggcatttcccaggatcaggtgaagaagcagcgctacgacaacggcatccgcgccgcctacaagatggtggacacctgcgcggccgagttcgcggctgagacgccctactattactcttgcttcggcagcttcaacgaggcggagcagacaaacggccgcaagaaggtgctggtgctgggttccggccccatccgcatcggccagggaatcgagttcgacttctgctccgtacacagcacctgggccttcagcaaggaaggttacgagacggttatcatcaacaacaatccggagacggtgagcacggacttcgacatcgcggacaagctgtattttgagccgctgacccctgaggacgtggagagcatcgtggacattgagaagccggacggggcggtggtgcagttcggcggccagacggccatcaagctgaccgaagccctgatgaagatgggcgtgccgatcctgggaaccgcggccgaggatgtggacgcggcggaggaccgggagcgctttgacgcgatcctggagcagtgcgatattccccgcccggccggacacacggtgttcacggccgaggaggccaagaaggcggcaaacgacctgggttatccggtgttggtgcgcccctcctacgtgctgggcggccagggcatgcagatcgccatctgcgacgaggacatcgacgaatttatcggcatcatcaaccagatcgcccaggagcatccgattctggtggacaaatacattatgggcaaggagatcgaggtggacgccatctgcgacggtaccgatatcctgattcccggaatcatgcagcacatcgagcggacgggaatccactccggggacagcatttccgtgtacccggcccaggatattacccagaaaaacgtggacaccctggtggagtacacggagaagcttgccagggcgctccacgtcaagggtatgatcaatatccagttcatcgtggacggcgacgacgtgtacatcatcgaggtgaaccccagaagctcccgcacggtgccctacatcagcaaggtgacgggaatccccatcgtgcctctggccacgcagattatctgcggacacaccatccgggaactgggatataccccgggattacagcctgcggccgactatatcgccatcaagatgccggtgttctcttttgagaaaatccgcggcgcggatatcagcttagggccggagatgaagtccacgggcgagtgcttaggcatcgcaaagaccttcaacgaggctctctacaaggcctttgagggcgcgggaatccgcctgcccaaataccggaaaatgatcatgagcgtgcgccattccgagcaggaggaggcggtggacatcgcccgcaggttcgcggcggtgggctaccagatcttcgccacccggggcacggccagaactttgaaggcaaacggcgtgaaggcctacgagatccgcaagatcgagcaggaaagccccaacgttctggatctggtgctgggccatcagatcgacctgatcatcgacatcccgccccagggcgcggagcgcagccacgacggctttatcatccgccgcaacgccatcgagaccggcgtacacgtgctgaccagcctggacacggccgcggctctggccaccagcctggagaaccgggccaaggaattgacgctgatcgatatcgccacggtgaagaacgcataactcaataacagagcggcagcccgtctccggccggtatggctgggcgggctgttttgcagatcagacggagaaaaatggatttgcggttgacaaaccacatacaacgtgataatttggttttaaggtaatactttataaaggcggttactgcatatggagatgcgtccatttttaaggaaaaatttgagcgatacggtgaaagccgagctttacgagtatattgacaacctggatctggataaggggacaaaactgccgccggagaataccatcgcgcagaattacggcgtgagccgcgttacggtcaggcgcgcgctggatgagctggagcaggagggcgtgatcatccgcatccacggcagaggaacctttgtcaatccccaggccaaacagtttaagatcaacctgggcgtgtcccaggagctgggacggctggtggatcagagcggatatgagatgcgaatctgtctgacggcggtggagacggccccggcggacatcattgtggctaaggcgctggggattcccgcggagagcaaggtgatctgcgtggagcgcgcgtactacgcggacgggaagctggccatcctgtgccaggataccgtggcggaggatatcttcccggagcgggtgtcgcgggaggattgggaggaaagctccaccttcgatgtggtgagaaccaaggcgggcaagctggcggtccgcgactggattcagctgaaaacggtgctggctcaggaggtcaagagtctgagcaatattgagggggaatttgactgcggctcggttctggagttcttcggactggtctacggccaggacaaccagccgctgatctatggccggacctattacaacaccaactatatccgatttaacctggtaagaaacattagtgcattttagaagtgagctgcttttgggcagctcacttttaaaaattttatataaggcaataccatagcgccataatatcataataacaaaggagaagaaaggggaaaggcaatggaaaggattgatggagcgcgtgtttcatattgccggattcatctcgtcgagtgtcagggggaaccggcttaaaaaccgttcccgccgcgctccgggtccgccgtcccgccgttctgcacatccacggggggctcgtcctcatgtaccaggatgtttccttttgccgccaggccgcgaaaaagcttcagccaattcccgagatcggaatctgcgaatggctgaaagaagaccagggcgggctggtcctgggagccgcccctgaattcagggaaagcgttcaaaacccagagcggcgcccgcagcacgaccggcaagaaggcggacagcggggcatcctccctcttgctgtaaaccattttgccgtccttcagcagacagaaaaagatgccgcactcgtaggcgtccggccaatcggccgggggaagacaaatctgctccggccagccctcccggttccggtccagcgggccgtacaggagcttcagccccgcttccttcagctctgcctcatactgttctaaaagcgggagatggcgcgcatactcctgtccaaagaggacagccgccgagcgcgggtcggcgtagcggctgcggaggcctgcctgcacgtcctcgctcaactgttccaacccgtcgagaggaacgccgcagtccgccagatgtatgagcagggcgatgatggacaaatcgctgcccggactgtgggggcgggacagctccagaaaacgcgatccgtccctacggtacagccgcaggcacagtttgccgtttcggtgctgtctcaaccgtccttcgccgagttcgcctgcgcgcagggcggcatccctccgaaacgggcggtgcagcgtcagacgccgcccatcgattgtcaaccggtctcccagacgcccggggaaagaggagaggagcacggagaaatgcctccggtccggattcgggtggagggcggagaaatgggcggtgctgaacattctcgctcccacatcgacccggattccgcgccgttccagctcctgcagaaggaaaatatgtccgggattgacagggctgtaatcgtagagccggaataaaacgccgtccctgcccttggcggtgcagatttgcagccggccgcagcagacctcctgtatctcatcgatccggtagctgcgggtcctggacaggaaatcccggatttgtatgtccgtgtccgtcagccggataaaacggcggctgtaccctataaaacccaggcccgatccaacgaacaggacaaacaggcacagggcgattccgccggtgggattggcctcggtgccgtccgccaggcaggaaagggtgatccaccatccaaacacaaactcaatgactcccaaaatttcaaagaggggataaccttttacgattatcccctcgctgtctgtttccgttttacgtctgttcatctcaaccctcttgctgttatgcgatcgtcgtacccgcttcccccttcaggctggccttggctttatccagggaagtgatgatggcgcagcggcccttgccgttctcaatgaaatccacagaggcggacaccttgggcagcatggatgcgaactcgaactggccctgatccatgtaatcccttgcttcctgaatattcatgcgcaggatgggcttctcctcgggagtgccgtagtttaacgtcacgttgtccacgctggtgagaatcatcagcacgtccgcatccacttccttcgctaaaagtccgctggccaggtccttctcaatgatggcgctggcgccgtggagattgtagccctgctccatcaccgggataccgccgcctccgcaggcgacgacgatctggtctgcatccagaagcgccttgatggcgtcgatctccacaatggccacgggatggggggaggccacgatgcggcggtagccgccgtccacctggacgacgtggttgcccttctgttcctcctcctgtgcctcggcctcggtcatcacacggccgatggtcttgagcggcgtgtagaacgcctcgtcgtaggggtcgacggtcacctgggtcaaaacggtggagaccggtttatagattccgcgcttgatcagctcggcgcggatgccgttctgcatgtcgtagccgatataaccctggctcatggcggagcagacggacatgggagccttgctgtagccgtcgtgctgcttgccgaattcattcatcgcagtgtgaatcatgcccacctggggggcgttgctgtggacgatggccacctgccatccatcctgaataaaatcagcgatcactttggcggttttcgccaccgcggccttctgttccgggagattggtgcccaggtccttgtgaccgactgctatgacgattcgtttttttgccataatccatacctcgcttgtctgttgattgttgtggcctgaaatgccgtttgttttctgaaattaagtttattataggttaaattggagaaaaatgcaattcaattatcgaaatccctatagtaaaacaaaaaataatgtgttatgattttcatagtgttgaaagaagcctatcagtaggaggaaaaattgtgaagctattatccgttgcaattccatgctacaattcggagccgtatatggaacactgtattcagacgctcctgaccggcggcgaggaggtggagatcattatcgtggacgacggttccaccagggaccgcacccccgagatcgcggacgagtatgcccggaaataccccaccatctgcaaggcggtccaccaagagaacggcggccacggcgaggcggtgaacgcaggcctgagaaatgccaccggcatctttttcaaggtggtggacagcgacgactgggtcaacgaggaggcctacgccaaggtgctggagaccctgcgccgctttgtgtactgtggggagaacctggacatgctggtgtccaactttgtctacgagaaggagggggcaaaacgtaaaaaggtgatgagctatcacactgcgtttcccaaggacaaggtattcggctggagcgacgtgaagttttttatgaaagggcagtatatcctcatgcactccgtgatctaccggacggctctgctgctccagtgcggcctgcagctgcctaagcacacattttacgtggataacattttcgtgtaccagcccctgccccatgtgaagcacatgtattatctggatgtgaacttttaccggtattacatcggccgcgaggaccagtcggtgaacgagaaggtgatgatcgggagaatcgaccagcagctgttggtgaccaagctgatgctgggatattacgatgtgaccaagatcgccaaccgcaagctgcgccactatatggtccagtacctggaaatcatgatgaccatctcgtcggttctggctatcaagtcggggacggatgagaatctggagaagaaaaaggaactctggcagtacctgaaaaagcagaatctgccgctgtatctccggctgcgcaccggatttttgggccagggctgcaacctgccgggaaaaggcgggcgcaagctgctgatcgccggctacaagatcacccagaaattttatgggttcaactgatattaaacagaagccggactccgccggagtcacgcggcgcggacggcgcgccgcctgccggatggtaacgtgaacgtttggaacggtaataaaaacgcgcaggccgcggaaacggggattccccggattccgcggcctgtttacgccggttgcggctggaacgcggagcgtcccggtcatagattgtatttcttatagagctttctgcgcagctcccggttacaggccacctgctccaccaggtcgatgcgctgcattttgatcagaagggagatcaggctggacagccgctcctcgccctcatcatttccctgctgaattccctgccggactccgtccgcgatcagatcgtcgattgccttgcacaaattaaatccctccccgtattctgtctgttccatgattttttgcagccgcttctgctcgccgatcagggagaagagggccatcagatctgtctgatccagtgagcgaagctcctcctgccgctcccgcacgaagttgtacagcgcctgcttgtctgtattatattttaacatgctgaaaatcagttgtaaatgggtgcgcagacgtcccggtatcgctgcaggacgcgccggcccttttccaggtccgcgatcataaccccggagtgtctgggaagagtcgtgaggtcctccggccggatgatctgctttccgtcgaaaatgacggcgttgcacaggtccgcaaaatagaccggttttgagattaaacagtttacataaagattttgttctgccattgcatccctcctctttaacagcagaagcagttgacaggtaaatggctgcgggatattcggcagaaacgccggatttccaggaccgggagtaaattcccgggaagaatcggtactgacaccgttttcttattatatcatatcggaaggaaaagacaagcggattttggccgccaacggcctgccacattcaaaaaaccgccctcccaaccggagcgcggtttttcaatctgccagtatatttatcccagaaccttctgcgtaacctttttgttttccgtggaccagccgtagccgtagaccacccagtaaatcacgtaagccatcaccacggaccccacgccgtcgatcacggagtgctgctttaaaaataccgtggacaggcagatggcagtcatcaggatgccggatccgatgcgcaccaaccggtgctttttcagcgcttcgctcttcatgatggcgatgtgcgcgccgatggagttgtacacgtgaacgctggggaacacgttggtgggtgtatccgtccggtacagggcggccaccgccgctgtaaatatatttttgtccggatccagggccgggcggaaatccgtaccgttgtggaagaaggtacagataatcaggctgatggtcatgccggagaataaaaacaggcatagacggtaataatcttccttattagtaaagaggaagtaaaggattgtgacagccacatacaaaaaccacatcaggtatggcacgatgaaatattcgttgaacgggatatagtcgtccatcgccacgtgcatcacatggtaattgcgggtaaccgtgcgctccagataacagaaccaggtcagataaatcaagccgtaggacagaatccacacatgactgtacttgcggagaaacgccgcgattgttttcataaaaccccatctctctttcttctaaagaaaccgcagccaaggccggtataaatgggccaggccatgtaaaaaaaccgttaattctttagcattttcggattatagcacattaaaaatggaaatacaagggggctaaggaaaagttaataatttttgagaaagtcttatggattcgaatcggaaattctttttttttagagcattgtgtgctatagtagttgcatgaaataaatttacacagaaatgatggaggatgaaatgcaagaaacgcgcagtgttttgggggcaatctgttcttcctataatacgtttttcgaggcggagaagaaaatcgcggactatatgatggagaacaaggcggcggtggtggatatgaccgtgggggagctggccagggccagtggcaccagcgatgccacggtttcccggttctgccggcgctgcggctttaaggggttccataacctgaagctgacgctggccagagaggtgctggaggatgagcagaaggatcagagcgtgtccaacgacattgaccggggcgatatccgccagtcccttcagaatattctggccaacaaggtggcggagctgacggaaaccgtgaacatgatggatgcggacaaccttgagcagattctgcgcaggctggagaacgcccggatggtgcagctggcggcggtgggcaataccatcccggtggccatggacggggcgttcaagctcaaccagttaggcatcccggcggtggccggcgaaatctgggaagcccaggcggcctataccttcaatctgggcccagaggacgtggtgttgatcatttccaactccggctcctccaggcggcttcagtccctggcccagggagccagggagaaccggtccacggtgattgtcatcaccaacaatccggattcccctctggcgcggatcagcgattaccggattgtcacggccacccgggagaagcttctgaccgaggagttctggttctcacgggtcacagccacggcggtgatggaaatcctttaccttcttttgctgaacagcaagaaagacgctgtggagcatattcgcaggcatgagaaggtgatttcaccggacaaacaatagcgggcaaaatgcacaaaaacaggcggctttcaggcggaaagtgcgcctgtttttgtgcgcagtgatgaaagtgcgcaagaaataaattttcgcataaaatactattgacgaaaatcaaacatcatactatgatagagacagagatgagaaacgaaatttcataaaaagagaggtatgcgatatatgatttacacagtaacgttcaacccggctttggactatgttgtgaacgtaaatcatttcacgctggggcaggtcaaccgcacggtgggggaacacattttctacgggggcaagggcatcaatgtatcggccctgttggctaatctggggtatgagagcgtggccctgggatttgtggccggattcaccggcgacgagattgagcggggggtgaaacgtctgggcttctgctccgacttcatccatgtgaagcgcggcatgtcccggatcaacgtgaagctcaaatccgaccaggagagcgagatcaacggcatgggtccggagatcgcggacggggatgtgggtgagctctttggcaagctggaggacttaaaggagggggatgtgctggtgctctccggaagtataccggcctccattgaaccggacatctacgagcggatcatggcccgtttggatggacgcggcgtgcgcatcgcggtggacgcggagaaggacctgctgctcaatgtgctctgctatcacccgtttctgatcaaacccaacaaccacgagctgggacagatgttcggcgtggagcttacgggtgaggaggagatcgcggcatatgcgcgcaggcttcaggagcggggcgcccgcaacgtgctggtgtccatggccggggacggcgcgctgctggtgacggaggacggacaggtactgcgccagggagtggcaaagggcgtggtgaaaaactccgtcggagccggggattccatggtggcgggctttttagccgggtacctggagacaggagattacggctatgcgctgaagctgggcacagcctgcggaggcgccacggcattttccgacgggattggaaccaaagacgagattatgcggctgttggcaacgctgtgagagatgaagatggaaacagaagggcagattattttataaggaggggcaattttcatgcggattaccgaattactgaaacaggaaagcatcggtttaaatgagaaggctgagagcaaggagcaggccatcgacaagctggtggcgcttatggaggccggaggccggttgaaggacaaggacgggtacaaggctggaatcctggcccgtgaggggttaggcagcacggcgatcggcgagggaatcgccattccccacgccaaggtggaggctgtggcggagccgggcctggcggccatggtcctgcccgaaggcgtggactacgaggcctttgacggctcactggccaacttaatctttatgatcgcggcgccggcggagggcgcggacgtgcacttagaagccctggcgcgcctgtccaccctgctgatgaacccgggattcaaggaagctctgattgcggctaagtccaaggcggaatttctcaaggtgatcgacgaggcggagacagcccggttcggcaccccggaggaggagaacgggccgcagggcggcgaggcgcaggaaggaaacgggcggcagaccgtcgcggagcaggaaggaaacggaccgcagaccggcgcgtccgcagaagaatcccgcaccggcaaaaatgcaaccgcagaaagcgccccctccggctaccgggttctggccgtgacggcgtgccccaccggaatcgcccacacctacatggcggcggagaatctggaaaatattgcaaaaaatatgggaatcgccctgaaggcggagaccgacggctccggcggcgcgcagaacgtgctgaccagatccgagatcgccggggcggacgccatcatcattgcggccgacaagaacgtggagatggcccgttttgacggcaagccggtgattatggtcccggtggcggacggcatccacaaggcggaggagctgatcaaccgggcggtgagcggcacggttccggtgtaccgccacgacggacagaaaaacgccgattccggggtagaggagaacaaggacagcctaggcagaagcatttacaagcatctgatgaacggcgtttcccatatgctgcccttcgtgatcggcggcggaatcctgatcgccttggccttcctctttgacgattactccatcgacccgtccaacttcggcaagaacacgcccctggcagcctatttaaagaccatcggcgaacaggccttcggcatgatgctgccgatcctggccggtttcatcgccatgagcatcgcggaccgtcccggccttgcagtgggcctggtggccggtctgatcgccaagatgggttccaccttcgccaatccggcgggcggcgacgtgaatgccggtttcctgggcgcgctgtttgcgggttttgtgggcggctacattgtgctgggcctgcgcaaactctttgagaagcttcccaagtctctggaggggatcaagccggtgctgctctacccggtgatcggcattttcctggcagcggtggtgaccacctttgtgaatccctacatgggaatgatcaacgacggcctgacccatttcctcaacggaatgggcgggaccagccggatcgtgctgggcatggtattaggcggcatgatgtccatcgatatgggcggccccttcaacaaggcggcatacgtgttcggcaccgcccagctggcagagggcaactttgaggtgatggctgccgtaatggcaggcggaatggttccgcccatcgccatcgccctgtgcaccaccttcttcaagaagaaattcacggccaaggaacgtcagtccggcattgtgaactatgtgatggggctgtcctttatcacagagggagccattccctttgcggctcaggacccgctgcgtgtgattccctcctgtatcgtgggctccgccctggcaggcggtctgtccatggcctttggctgcacgctgcgcgcgcctcacggcgggatcttcgtgctgcccaccatcggcaacccgcttctgtacctggccgccgttgtggcaggagccgtggccggctgtctggtgctgggggcgctgaagaaaaacgtggaataaccacaggtgcctgatacaaaataaggggagtatttggcagataaaagaggaccgttttccctccgcattggcggtgggaaggcggttcttttctatttcaacgggctccggaaaaccagaaaaacccagatgctttttccataatatactgtataatagaatacatgaagctattgcttgacgaaattatggaacaacggaacttaacagagcgtcaggtaagtattctcacaggactatcccgctcatcggtgcatgagattcggaagggatccatgccgcgggtcgacacacttgagcaactggcgaagggactgaagatcaaaatttcagacctgattgaaagcgactacctttaaataacaaaaagcgctcggatttccgagcaaaatcagccgcagggcttgaaaatgcgctatacttggagagcaaggaggcgcatgtttttatgaatgagatggatgaattgctgcagcgtctgtaccggaattcggacgaggacctgctgcgggagtttaaggcggcggaggccgaggtggaggccgaaggaggccccaggccggacccggaagggtttgaacggctttggaaaaaaatggttagtgagtttcacaaggacaggccgcggtaatccgggcctgtccgcgtttttgtccgccccattttcgcggggccgcgttaaaatgcaatttacatccggaagggattgtgataaatttaaggacagcggtatgtgaggattgacctcgcaccggtcaggaggatgaaatggattatacaaccgatatcagaaacttaaagcgctgcgtggagatttcccggcagtcgcgggcaaacggcaacacccccttcggcgcgctgcttgcggacaaagagggaaatattttgctggagcagcccaacgtggagatcacggagaagaagtgcacgggccatgcggagactcaggccgcggagcgggcttcccaactctactccagggaatttctgaaggactgcaccctctacaccacggcggagccctgcgcgatgtgcgcaggcgccatctactgggccggcatcggccgtgtggtatacggcatgacggagaaggagctgttggcgcaaaccggcgcggatccccagaatcccacctttgacctgccctgccgggaggtatttgccagaggccagaaggaaatcgaggtcgtgggccccttcccggagctggtggaggagatcgcagaggtacacaagggatactggaacaactaaaaaacagggtgcccccaatgccgttttcagacatttggggcaccctgtttgtcgattcgctggtttgattatgccacgcagacgttcacagcctgtaagccgcggttgccgttggtgatatcaaaagtcacggactggccgtcttccagggacttgaagccgttggaagcgatgccggagtagtgaacgaagatgtcctcgccgttctcgctgttggtgatgaagccgaagcccttctgagagttaaaccattttactgtacctttattcatgaaagatacctcctgaaatataatattatattttttgataaaactaaaaaaaatcacacgtttttgtaaatcatcataggaataatgacttacaaaaacatgtgaaatcaaaatcttataaaaaatacttcttaactatagcacggggacggcggggtgtcaagggttaatttaaattaatttcttccatcccctcacccgcggtctgcggtccgcggtcccaccgccctgattccgttctattccctccgcttgggtttgcggcccaccggccgtgcgcccttgttgatctcaaaatccttctgtatcacctgattgtacacggagagcaccttgtagaaggcgtcgatctcctccggcgtacactccttgcgcagttcgcccatggtcttggtgatgtccagggtatcgtagagcttgtgggacttgctcagccggattccctgctcggtggggtacaggcagacattcttggcgttgtcctctttcttttctttggtgatcagtccccattccgccaggcggctggcagtctgggacagggcgccctttgttttcccccagtatttggcaagctcggtcaccgtgacgccgggatgctcttctatataagtaagcgtgtggacctcgatcatggtcatggggatgccctcaccatagtcgtgaaccgaaaggatatagtcattataacgcattacgaactggtaaatgctgttgtggcgttcgtttaacgtgtgaaaggtctggtctatgaagctgtcgtccgacggcaaaagcttagcggaatccgttgcatccatctttgcgctcctcctttgcaaatgcgtagtatttcccaattataatgtcagtttagcacagacagaacaaaaaagcaaatggtttagcggaaaaacaaaaatagaaaaatggtttaataattaaacaaaaaatattgacaaaacatcgattgtattatataatccaaccatagatggtttaatcattaaacaataatttgaaaaaatgtggagggtttgaacaatggaagtaaaagaattttgcgacaggtactatgtggaccgcaacggcacggccagcttgaagtgggatgcgcttcagacgcgcttcggagatccggacctgatctccatgtgggtggcggatatggagttcagaacgccggagtgcgtgaccgacgcgctggcaaagagagtagcccacggtattttcggttattcctttgtgccggactcctactatgaggcggtgatggactgggagaaggaccaccacgggtatcagctgaagaaggagtggatgcgcgtatccccgggtgtggtcgcggcgctgtactggtctgtgaacatgtacacccagccgggagattccgtgattatcatgacgccggtctactatccattccacaactgtgtcaaggacagcggacgcaacctggtgacctgcgatttgatttacgaccagggcgtttacaccattgactatgagggctttgagaaagcgattgtggaaaacggcgtgaagatgtacatcctctgttccccccacaatccggctggacgcgtatggaaggaagaagaactggagcggatgctggagatctgcgcgcggcacaacgtgttggtgatctccgacgagatccatcaggacctggtgttcggcggacacagacatattccggcggctaccatagccgggggcaggtacgcggaccgcatgatcaccgccttcgcctcctccaagacctttaacctggccacctgtctgacctccaccatcgtgatcgagaacgaggagctgagaaaaacctgggatgattttgtcaaggtttacaattcggtggaagtcaacgtgttcggaattacggctgtggaagccgcgctgcggggcggcgaggagtggtaccagggagtgaagaaggtgatctgctccaactatgagaccgtggtggaggagatgaaggaattccccggggtccatatcgcgcccctggagggaacctatctggtgttcatggatttgcgagactacgttcccgccgacgatgtgcgcgactttacccaggagaaatgccgcctggccgtggactacggcgagtggttcggagagaactggaagggcttcatccgcctgaacatgggcacccatcccgacatcgtaaagaaagcggtggagaacatcaaggaaaatttgagaaaaagaaacgcgtaagcccgggctgtgaaactgtcaacatggtaagaaatatggtatattagaaaaaggtggaaaaatgaaaacgctgtggaatacatataagtcttcgattatgttacttggcgcgatggttgtgggaggcgtcgtgggcttcttctggggagagggggctgcggtgctccagccggtcgcggatctgtttctgaatttactgtactgctgtgtggtgccgctgattttctgttcgctgacagcggccatcgccaagatggaaaatctggccaagctgcgaaaaattctggtaaccttcctggggggaaccattataaccggagtgatctcctgcctgtttatggtggtggcggccctgctgtttgacccggccaagggcgctgtgctcaacatgaccgaggaagtggagaacatgaccagcagcatgaactttctgggcatgtttacagtgggagatttcccgctgctgttctccaagagcaacctgatggcgctcatcgtgtttaccatcatctttgccatcgccatcattctggccggagagaagggcaagcccgtgctgcacctcatggattgcatgacggaggtgatcgtcaagctgatcggcatcgtgatgaagctggctcccctgggccttggctgctactttgccatcctgatcggccagtacggccaggaagtgatcggaccgctctcgcgtgccatcatcatttactgcgcggtaatcgtcctgtattatgtgatttcccagacggtcatggcctacatcggcgccgggccggagggcgtgagacggtggtggaaaaccgccgcggctcccacgctgacggctctgggcacctgctcctccgctgccacgctgcccctgaacctgatccaggccaaggaactggggattccctcggatatcgcggacgtctccattcccctgggggcgaacctgcacaaggacggagcctgcattatccagatcctgaaaatttccttcctgtgctccgtgtttaatatcaactacgcgacgccgaagaacattctcctgtccatcgtcatcgcggtggtggcctctgtggtcatgggcggtattccggcgggcggatatgtggcggaaatcttcatcatctccgcattcggcttccccacggtctccatcccgatcatggtgctgatcggtaccatcaccgacgcccctgcgactgtggtcaatgtgaccggcgacaccggcctggcgatgatcatcgccagagtggtggacggcaaggactggatgaagcggtcggataaaacgcgaaaacaggctgaaagcgggatgaaaccggtattaaccggagctgcgggcgcagaataaaacggacggggcggttcgtataaacgggtgttgcatgttgtaaacggaacaagacggcggtttcctttgacagaaggggccgcctgagaggaaaatgagtatggatgacggtcgaagaaaatatggtgccatggcatttttgcccctggttgtgtttctggtcatttatgtgggctgcggtatcacctttaccctgatgggcgcggagagccccttcgggatgtttccgcgccatgtggcgattctggtgggaatcggcgtggcgctgcttttggctccggagatcaaaatcagcgaaaagctggacgtgttctgccagggcatgggcaattccggtgtcatgatgacgatcctgatctatttgatggcgggaggcttccagggagcggccgccgccatggggggaaaggaatcggtgatcaatctgagcctgagcgttctcccggtttcagtgctgatccccggcgtgtttctgatgtgctgcctgatctccaccgccatcggcacgtccatgggcaccatcgccgccatggctccggtggccatcggcgtggcccagggagccgggctcaacctggctgcggtcagcgccgcggtgatcggcggagcctatttcggggacaacctgtccatgatttccgacactaccatctccgcggcccagggctgtgggtccgagatgcgggacaaattccgcatgaatttctttatcgcgcttccggcggcgctggcggcactggttctctacaggatcgtgggcggaggcggacagggcgcgatccaggcaggtccctttgacgtgatccgggtgctgccctatgtggccgtgctggccaccgccgtgatgggcttaaacgtggccgtggtgctgtttctgggaatcctgctgaccggagtcatcggcctggcccagggtacggtgggatttttcacctggattcaggcagtgggcgacggaatgagcgacatgttcagcatcagcatggtggcggccatgatctccggcatcatcggtctggtgcggtattacggcggggcggagtggctggtcggcgcaatcaccgcccggatccgaaaccgcaggcaggcggagtacggcatcggcctgatgtccggcctgctctccgcggctatggtgaacaataccatcgggatcatcgtgacctgccccatggctaaggagatcggcggaaaatacaggatcgcgcccaaacgcctggccagcctggtggacattttcgcctgcgcattcctggcggtgatgccccacgacggcggtatgctgatcgtgacggaactggccggggtgtcgcctctcagcgtgatcaagtattcgttctatatatttgggattttgatctccacctgcgcgaccatacagctggggttgatgaggacggaggaggagaagcgggggtaagatttggatgggtggtagattgaagcagtagcgtaatatcacctatccgggtattctaagaaattaaaaaatagtgctaagtctcaaggataaattgaggcttagcactattttttaccgggagtggcggttatcgattacttttacagtctttaagcctacaccgccgcctcggcgacatcaaaaacagtttcaaatcggataccgttattatagaggaagagactataaattttcgtgataacgacatttcggaaatctggaacaaccataaaactgttctccggcgtgagctcccttcttggttgttctaagtacgagcggactagtacattttggacagattcgattgaccggggtatccgcttgagtattgtcattagccggaatggaaggttttgaaaaggcaataattttttgaggattgtcaatcggttcaatggccgctttgggaatatttgtcttttccttaatatccgctatatgcttatctttcgttgaatcctctacctgcgtgtatgggtaaagcgttgtatagatgttcgcaatttctgcttcagttaatactttgagctggcttgaacatattttattaatcaaatgatttattgtattacgcttaattacataaatattgggacttgtacattcaacctttttcaaagtacatcgttctgagaagacaataattgaatgaaacaggacccttttcccaaacaactttgggacagacgaatttgtatcgtgtgaccccgcttttaagcttacaggttcataaatatcctggcaatttgaaaaatatctgcaaaagaaagctgattgtatggtattataaaggtacaatgcctttcaggtggatatggttgattgttctcaacatctattaaattattggtaactatttaactaaaatagtatcggactaaaattcgattttcataagaggagaaatcaatgacagcacaaatcggagatatttacaaatacaaaaataaagaatactcaatagttgccatgtcttcacctattaactttaaaccggaggattatggattggaacctcagtctaggtgtacagcatgctggaatggatattggtgtgaatatcatattgagaatgatcgattgttgctaaaaaatctgtttatgtttaatagtgaaggaaactatccgttacttaatggggtaggcgttgtggaacagacctatcatgagggaacaagttataagctgggagaagggaaacctaaaaaagtaatgctggaagatcatatggggcatcgtgaatatagaaatgttaatttgccgattaaatacacagggaaaatcttagtgggggatggtttcattcgagattattatattcatatgggatatcaaagggcatgggcctacaatgagctgttagagttcgttttcgaaaaaggaagcctaattgaaacgattgaccatagcgatatggcagaaaaaataagatgcgagcttaaatcaaatgatacaaatattaaaaatgaacgggaaaatatagttttattgatagagaggagcttttcgctggacatgaaggataaggcatggtggataaaatagaatcgggttttcgtgtcggtaggaaagtgtgattaaatgggtgatatagtgaaaatatgcacatattgtaggcgtgaaagtgatgacgaaatcgaggagtgcccttactgcggagcatctgagttcattaagaaaaaccaggatatttttgtagaggagagcgatccggttgcggtagaaccaatatttgaaaagaaagcgtctttgatatacagaattattaagtatattctagtgggaatatttttttactttttgatattagttatcttagcatttattgtgcttatatatgttgttattactggaaatgtcccgggctttttgctgatagaatcaatgtgaaagagtcagtaactctttagatcaagatgaaaggtgctgtgattatggcagaggtataaaaatggatcgcaattttactggtgacataatgcaggaatttatattgcctatacggtgtggaatgacaatagaaaaggcaatagaacgattgccggatataccatatcaggctacggacaaggcgatatattttgaaatgtttaagagatatccgaaagagttgattgaacagattcgaacagtatgccccaactgtggaaacagaaaaattgtaccggtactattctatagcagagagaatgtgaaacttgtagaagaaggtaaagggattctggctccaggtgcatatgacaatccagcgttccttatggtaactatgggtgcttggaatgtgggtatagatggttatatcatgttcctggctggaacattagctcagaatagtggtgggaatgaccatttagttatctaaaggccgcggaggcagagatggaggccgggggcggcccgcagccggacccggcgggattcgaacggctgtggaagagaatgaagcgggaatgcaaaaatggcgggcaccagtgatggcagcccgccattataatttagtccataaatagtccataaatccattttcagcattccagttcaaacaatcaaaaaacctcgtaaacgttgaatctacgaggtttttcaagtagcggaagggagatttgaactctcgacaccacgggtatgaaccgtgtgctctagccaactgagctattccgccatattaggtttttggatggggcctatagggctcgaacctatgaccctctgcttgtaaggcagatgctctcccagctgagctaagacccctcatccaccgccgcgcttgtctcactcgcgactgcttgaacagtatatcccatattgttttaattgtcaatactttttattccatttttttatagaaattttcttagtgttttcaactataatatgatatactaaggaaagaataaatatgggagggtttcatgtactattttattgtgaatcccaatgccgggtgcggaaaaggcggcaggctctggcgggccgtcgccatttatctggaaaagcatcaagtggaatatgaagcctatcttacagctggcaggggcgacgcccggaacattgccagggaactgacggatggcaaccgggaaccgcaggtgatcgtggcggtgggcggggatgggacgatgaacgaggtcctggacggcctggttttttgcggccctctgaccctgggatatattcccgccggttccggcaatgacctggccaggagcttgaagctcccggggaatccggtgaaggccctgaagcgcctgctgacgccgcggcattaccggatgctggattacggtattctcacctacggcacccaggaggtcagccacaggcggtttctggtcagcgcgggcatcggcttcgacgctgcggtctgtcacgatctgctggagtccaagctcaggcagcggcttcggcgcgtgggcctgggacggctttcctatttgatatccggcatccgccagttatttaaatgcaagccctgtaagggctatatcatattggacggggtgaagaaggtggagttcaaccacatcgcgttcatttcctgtcatatacagccctttgagggaggcggcttcaagctggcgcccagggcgaattgcagcgacggaaagctttccgtgtgcgtggtcagccacgcggccaggcgcaagctggtgcccattcttctggagtccctgaccgggaatcacggcaggcgcaagggagtgagaacttacgagtgcggggagcttttcatccacacggagcggggacttccggtccatgcggacggggaaagctgcgggatccagtcggatttgcagttggggtgcattgcaagaaagattcggattgtgggatagtgtttggcgctgcgcaccgcagcgccgggataagtttacagcgcgggggccggcgccgggacagggagatgttccggtggggcgcccgttgtctgattgtatgcaatggtctgcgtgcgcttacggaatgcaatgggacgtttgcgcggccggcgggccggatacaatccatacggcggatcagaaccggctccggccggtgaggacgaacacggcagaacatgattgatcagaatggaaaggaatcggacagattatgagaatcggacaaggatacgacgtacaccggctggtggaggagcgcaggctgatcctgggaggagtggagatcccctatgagaaggggcttttgggccactcggacgcggacgtgctggtccacgcggtgatggacgcgcttttgggggccgcggcccttggggacatcgggcagcattttcccgacacggacccggcatataaagggatttccagcatagaactgttaaagcacgtgggggcgctgctggaggaaaagggctatgtggtggagaacatcgacgccaccattatcgcccagcggcccaagctggcggcctaccgcccgcagatggcggagaatatcgcagaggccctgcatctggaaccgggacgggtcagcgtgaaggctaccaccgaggagggactgggctttacgggcagcggcgagggcattgcgtcacaggcaattaccttattgacggaagtggctgattactgctatgataatagaatgattcaaaccggctgcggcggctgtggcggctgccagaagaacgacggggcggaaatgtaaaaaccgaggagagtaagagtatgaaaatatttaacacgctgagcagaaggaaagaagagtttgttccgttgactccgggggttgtgaagatgtacgtgtgcggacccacggtgtacaatttcatccacattggaaacgccaggcccatgatcgtgtttgacaccgtgcgccgctattttgagtataagggctacgaggttcagtacgtgtccaatttcacggacgtggacgacaagatcatcaagaaggccatcgaggagggcgtggacgcggataccatttccaagcgctatatcgaggagtgcaagaaggacatggcttccatgaacgtgaagccagccaccgtccatcctctggccacggaggaaatctgcggcatgctggatatgatcgggaccctgattgagaaggggcacgcctacgcggcggccgacggcaccgtgtatttccgcaccggctcttttaaggagtacggcaagctgtcccacaagaacctagaagaccttcagtccggttttcgcgagatcaaggttaccggcgaggagggcaaggaggacccggcggatttcgtgctgtggaagccgaaaaaggacggggaacccttctgggagtctccctggtgccagggccgtccgggttggcacatcgagtgctcggtgatgtccaagaaatatctgggagaacagatcgacatccacgcaggcggcgaggacctgattttcccccatcacgagaacgagatcgcccagagcgaatccgccaacgataagccctttgccacctactggatgcacaacgcatttttgaatatcgacaaccggaaaatgtccaaatccctgggcaatttctttaccgtgcgggagatcggggagaagtacgatcttcaggtgctgcgcttctttatgctcagcgcccattaccgcagccccctgaatttcagcgcggatctgatggaagcctccaagaacggcctggagcgcatcatcacctgcatggagaagctgcgggatctggaaagcaaagcaagcggcaacgcggaaacctgcgacgagcagaacaacatggcccaggccgatggcctgcgcgggaaatacgaggccgccatggacgacgatttcaacaccgccgacgccatttctgcggtatttgaactggtgaagctggccaactccacggcggatgcggacagcaccgcccgctatgtttcctatttaaaggatatgatccaggagctgtgcgacgtgttgggaatcattaccgagcgcaaggccgagaccctggactcccaggtggaggagctgatcgcagccagacagcaggcgcgcaaggagaagaacttcgccctggccgacgagatccgcgggaaactgctggatatgggaatcgtgctggaggacaccagagagggcgtaaagtggaagagagtgtaacgttagcggattttttggagtattataagaaaagcatgggactggagccggtggacgtgcggacttactcgccgttagtactggcctacatcggggacgcggtgtacgagctgatgatccgctccaaggtgatcaaccacggcagcatgcaggtgaacaagatgcacaagcacagcgccgctctggtgaaagcctcggcccaggcccagctgataaaggccctgcaggaggagctgacggaggaggaactggcggcttacaaacggggccgcaacgccaaatccgccaccatggcaaaacacgccaccatgatcgattaccgcatggccacgggcctggaggctcttgtgggctggctgttcctcacggagcagtacgccaggctggcggagcttgtgagccgcggtctggtcaaggccgggcttttggagtcgtgggacgaaaaaggagaaacagaaggatgagatacgaagaattgaccatagagggtcgaaacgcggtgctggaggcttatcgcgccggaaagaccattgacaagctgttcgtgctggacggctgccaggacggcccggtgcgcaccattgtgcgggaggcgaaaaagcacgacaccatcgtgaattttgtggcgaaagagcgcctggaccagatatcggagaccggcaagcaccagggcgtgatcgcttacgcggcggcctacgagtacgccgaggtggaggatctgttaaagctggccgaggagaagggcgaaccgccttttctgatcctgctggacggcatcgaggatccccacaacctgggcgcgattatccgcaccgccaatctggccggagcgcacggggtgatcatccccaagcgcagggccgtcggcctgaccgccacggtggccaagacctcggccggagccctgaactacaccccagtggccaaagtcaccaacctgaccgccaccatggaagatctgaagaaaaagggaatgtggtttgtgtgcgcggacatgggcggcgaactcatgtaccgcctgaacttaaaaggccccatcggcctggtgataggaaatgagggcgagggcgtcggcaagctggtgaaagagcattgcgacatggtcgcctccattccgatgaagggggacattgattcgttgaatgcatcagtagcggcgggcgttctggcgtatgagatcgtaagacaacgtttgtcctaaggggtaccgggcaaagcccggtggattccttaggacggccagcgaattccagcaataggcaacatccccccaaaaaaaactacctctccacctctcagtaaaggagcaatggttttatgaagaaaaaagccattttaatacccataaccgcccttgcgcttgccgccggctccaccggctgcagcgcgggtaccgtcgcaggcaccggcgccgccccagcctatgaatccgctcccgcggagacatccgccgcccagctcgctgcccagtccctggccgatgccgcccagcccgtcgtcatcgaggaccaggcggttccgctttatagcaagccggcgggcagctatgtgcgcacgcccatcgcctccggtaccgtgacctatgagaacaacctggcgctgttagacgcctccaacatgggcgagggttatattatgctcaaatacctgggcagcaaccccaagatcaaggtgcagatcaccaagagcgggtccaccacctatacatatgatttaaacaacagcggcgtgtacgaggtgtttcctctgtccgaaggcagcggttcttatcaggtgaaggtctttgaaaatgtctcgggcaaccagtattcccaggccttcagccaggatgtaagcgccaacatcaccaacgagtttgggccgttcctgtaccccaaccagtatgtgaatttcaacgcggccagcgccgcggttcaaacaggagcggcggtctgcgccggatcagccgaccaggtggccgtggttgcggacatctacaactatgtgatcaccaacatcacctacgacacggccaaggcggcctccgtccagtccggctacctgcccaatgtggacgtggtactggcccagaaaaagggaatttgttttgactatgcggctctgatgacggccatgctgcgctcccaggacattcccaccaagctggtggttggctacaccgggaacctgtaccacgcctggatcaacgtgtatctggacggtcagggctgggtggacaatgtgatctatttcgacggccacgactggaagctcatggatcccacctttgcatccagcgggaaccagagcgaggagatcatgaagtatatcggcaacggctccaactatcagggcaagtacagttattgacgattaggaggacatcggggcgagtatgaaaaagccagaaaaaccttaccaatattcctatcaggagttgtcggccttctgcctgcagattggccttctgctggaggcggccgtgcctctggatgagggcctggccatcatggccgaggacgcgggctgcgaggacgaaaagcagctattactctacatggccgagggcgcggagctgggagacccgttcttcaaagtgctggaggacgcgggtacatttcccctctatgtggtgcgcatggccaagctgggccagcagtccggcactctggaccagatgatgaaatccctttcagactactatgagaaggagtaccggctgctggtcaatgtcaagaacgcgctgacctaccccatcatgatggtggtcatgctgctggtggtgctgttcgtgctgttctcgaaggtgatgccggtctttgaccaggtgtacgagcagctgggcgcgaaaatgtccccggcggccagatcagccatccggctgggcggcctgttcagcggtgccgctctgatcgcagccgcggtgatcgctctggccgtgttcggcatctgggctgcatcccggttcggccacaggattacccttgtggacaagatggtaaattatgtaaaatgtcacagccgcatcgccttggccattgcaaaccgccgtttcacctccgtgctggcgctcacgctgaagagcggcatggagtttgagaagggtctggagctggcgggcgagctggtggacaacggcaaagtggccgcgcagatcgagaaatgcggccggactctggagaccggagccagctattaccaggcaatgaaggagaccgggctgttttcgggcttctacgtgcagatgatcaaggtgggaagccgcagcggccgcctggacgcggtgatggaagagatttccgaggatttcgagcaggcggcggaccagtccatggacaacatgctggcccggtttgagcccaccatcgtggcggtgctggccgtctccgtgggcttggtgctcctgtcggttatgctgcccctggtgggcgtgctggccgcgatcggatgaggacgttatagatgagagttgacagaagaagcagacgaagaaaaagccagacgaagggctacctgctatccgcagcagcccttctgctccttgtgggcgtgtttgcggccggcgcgctctcctttgcggggaaggccgggcaaaagggggaggaatccctgcgccgggcggtgaccagggcttcggtccagtgttacgccatcgaggggcgctatccgcccagcgtggaatatctggaggagaattacggggtccgcattgaccgggaccgttacaatgtattttacaacggcttcgcatccaatgtgatgccggagatcgtcatcaatcccattgaggaagaggaggcgcgcagatgaaccggacggcggcgagaagaagcaataaaatgaacgcgcttttcaccggcctgctgttcctggtgttcgttctgtgcgccctttttaccgtgctcatcggcagtcgagtgtacgagaatatcacggtgcgcagcaaccggaatttcaccggaaccacggccctcagttacatcgcgaacaaggtgcgccagggcgaccgggagggcatggtggaagtgcgggaaatagacggcgtgccggtgctggtcctgggacaggacctgaacgatacccgctatgagacctggatctactatcaggacggttcggtgaaagaactgttctccaacccggagagcggcctggggttgaaggacggtctggatattctggagtgctcggggcttgacgtgtccctctcggaccgtctgctgaccatccgcactctgggcgagggcggcggcagcctgaggctgtatttgagaagcggaggtatctgggaaaatgagtggtaggcgtggatccggctccgggccgtttctgatggaaatgatcctggtgagcggattttttatcatatgcgcggcgctgtgcgtgaccgtgtttgtcaaggcggattccaccagccgcagggccagggatatcaaccaggcggtgctggcggcggagactctggccgaggagattaaggcgggcaaggtggaaacactgggagacggccttcccatgccggaccgggatttcagcggatttctggcccagtgggaaaatgatgagcagagagcgcgccgggagctgatttcccaggctgaggattttcacagctatgcgccggtgtgggatgaggactggaaccgctacccggacgccggggcgttggcggcggccggaaaagagaccgcctacgccgcacaggtgctctgcggcacggtggaccacatgcagatgacgcagatcgtggtcatgcgctatggggcgcgggacaagggaacggtgctgtacgcgctgaacgcggatcagtatatcaaaccataacagagaaaaggcgggatttgacagatggcgagggaatcgggcggaggaaaagtgaatatcggagcggcttccctggtgctgatcttcatcgtgctgtgcctggccaccttcgggctgctctccctgagcagcgccaaaggcgacttaagtctggcggagcgccaggcggaggcggtgagcgcctactatgaggcggacagcaaggggcaggagtgggtgcgccaggtggacgcggtgctgcaggaggagatgggacattccgacgactcgtcctcagccagcgatgccgtcaaggcgcgtctgggagagatctaccatcaggacgagggaatggtggtcacggacattcccatggagcggggacagtccctgcgcatcgagctgacgctggtctgcggcgagggtatgcgctatcagattcattcctggtacgtgtacgacagcggccagtatgagatcgacaattcgatgccggtgtgggacgggagttccggcgcttgatacgttttggaagatttcatcgcgcctcctggagcagagcgcggctcatttagcggcgcggggatatgcaaaaattgttataaaaggagcaaactagaaccatgaatgtaaaggaattgctgacaacggcggtggagcaggatgcggcggacatctttctggtaccgggcatgccgttttcctacaaaatcggcggccggatcatttaccagggccaggagaagatcatgcctgaggagatggatcgcatgatcacgcagatttacgagctggcgaagaaccgcgatatggctaaggtgcgggagcatggggacgacgatttctcctttgccattcccggcgtttcgcggtttcgcgccaacattttccgccagaggggatctctggccgggatcatccgggtggtgcgctttgagcttccggacccggaagttctgcacctgccgaagatgatcatcgatgtggccaagatgaccaagggaatggtgctggtgaccgggccggcgggaagcggaaagagcaccaccctggcctgcatcatcgatgaaatcaaccggacgagaaacgcccacgtgatcaccctggaggaccccatcgagtatcttcaccgccataaaatgagcgttgtgacccagcgtgagatcgtcacggacacggacagctatctgaccggcctgcgcgcctccctgcgccaggcgccggacgtgattcttctgggggagatgcgggaccatgagactatcagcacggccatgacggcggcggagacggggcatctgatcctgtccaccctgcataccatcggcgcggccaacaccatcgaccgcgtgatcgacgcatttccgcccggccagcagcagcagatccgcacccagctctccatggtgctggacgcggtgatctcccagcagttgattcccaccgtggacggcggcgtgcagcctgcgtttgaggtgatgtttttgaacaacgccatccgcaacatgatccgggaatccaaaattcaccagatcgacggcgtgatcgccacctcccagggcgaggggatgatttccatggacaacagcatcatcagtttgtaccgaaagggagccatctcccgcgaaaacgccatcgcctacagcagcaacagcgagctgatggcgaaaaagctggaccgttagacgttagacgctaaaacttatgaatcggcgcgccggagctgcatataatgaggaaaaacggagcaacctgaacactgtaagcatcggggagcggaaatgcgggtaaacggcccgggatcagaaccgcttcctgggaaagtgagtggaagaatgagagtagataagcggaaagtggtaatcgttggcaccgggatggtagggatgagctacgcctacagcctgttgaaccagtcggtctgcgacgagctggtgctgatcgacgtgaacaagacccgggcgatcggggaagccatggacttgaaccacggcctggccttcgccaacgccagcatgacgatctacgcgggggagtacagcgactgcgcggatgcggacatcgtggtgatctgcgccggggtggcccagaagccgggggaaacccgtctggacctgttgaagcgcaacgcccaggtgttccgctccatcatcgatccggtgacctcctcgggctttaacgggatattcctggtggcaaccaacccggtggacatcatgacccggatcacctgcgtgctgtccgggttcaacccaaggcgggtgctgggaagcggcactgccctggacacggcgcgcctgcgttatcttctgggcgaatacctgaaggtggatcccagaaacgtacacgcctacgtcatgggcgagcacggcgactccgagtttgtgccctggagccaggcgctgttggccaccaagcccatactggagctgtgcggcgagaacgacgcggtctgccgggaacgcctggaccagattgaggaggaggtgcgcaccgcggcctacaagatcatagaggccaagaacgccacctactacggcatcggtatggccttaacccggatcaccaaggcgattctgggagacgagcacagcgtgctcaccgtttcggccatgatgcgcggcgatttcggccagcgggatgtttttgtgggcgcgccctgcatcatcaaccagaacggcatccagaaggtactgcccctgtctctgaccgacggggaaatggaaaaaatgagcaaatcctgcgatacgctgcgggaaagcttcgagggaattttttagcagagaagagctccgggcaggagctcttttttctatggaaaggggcgctgcagcggaaaggagcgcggtggaacgggaggcggcggaacaagcgcagcggtgatttacgcatcctttaccggtatgatgcggaatccgtagggggaccaggtgttgcccagcagatacagggtgtagctctggcccggctgcaccgtgagggaggtggcggcgatggggccggagagccactgataaccggagtcctcggtcacatagaagctgtaggggccgggcggcagcgtgcggtagggggtggccgcgccgaaggggatctgctggtgcagggggattccgtcggcggtgtggagtgcaaaggaggagtcctccatactgacgttcacggtgcgcaggcaggcctgatcccgggtttccggcgcgcaggactggtcgataaactgcaaaagatccacgccctggcctgcggagtccaccagcactgcggtggagtgtgcgtccggtgggaaaatgagctctttttccaacagcagggcgttggagggagactcctgggtcagcctgacgcggtgggaaccagcagacaccgcgtcatagtcggtcaggctggagaaaatggaacccgcgacccgagggacgcggtccagggcaagattgacgggaaacggggtggatgcggcgtttaacaggcgcgtcaggccggttccggaatagggaacggccatccccggcatggcgccggtatcatccagataggccgccggcgtctcatggaaaaagccgttgttctcataatcgtttaacagatcggacatttgaattccttttaattgagcgtttgtacagtatatgacagggggcggcgggaaagtcgcgggggagaaaacaagttttgcccgcaggccgcgccggcggcacgctgcatgaacaatcgccccaggctgcgcgggcggcccgttgtattcaaaaaaggggattggccgccgccaatccccgaagcaatcacgttttgaactttttaagattcttatagtagagcgccttgtcggactcttcctccacgaattcaattaaatccccggccgtgcatccgaaaaacgcgcacaatttgcagatcagattggcgtcgattctctgaaattcatcccggcaatagcggttgaagttggcccttgggatatccaggaagtcgcatagagcattcttgctgatatccttttccgccagctgtttttctatattcaagtgtaagtatcccatttgcgcaccgcctctctgataaaattatatccaagaaaaaaaatatctagtaattcactgtatagtaagttacaatatagtgagttattaaatagagaggtgagggttttatgtcaaaagaaggttttcaaagtctgatgaggaaaatggaggaattcgcccgggcaaacgaccggatttccgtcccggagcgcaggcgtgcggtgataagcctgtaccggcggctgcggcgtgagcttgcgggcgaagccaaaaccggcgtcagggaaacagggggttccgcctccatccgaatcctggcaaaggacgggctgatcgcgtgcgacgagtccgacgcgctgttgaagctgatggccatggccaatctgctttgcgtcaaacgggttggaaatcagattcagatggatctgtggtttcgctgctgggagtggaaaaagagaacatagacggcgacagacgcaaaaaaacccttgaacaatcaagggttttttaaaagctgctgacgggaatcggacccgtgacctccgcactaccaatgcgacgctctaccgactgagccacagcagcttgtttcatttggtcgctctcgcgaaccttgtatatattatcatggggaatcagatttgtcaacagcatttttaaaatattttttaaatccgcaggaacggcgtccggttccaccaggggggattaagaaacagttgaaaaaagtccggtccccaggtatgatgaaagatgacgaaaatcctgtaaaaacagaggagaatgaccgggaaacggactgacaggcgggggataaatgatggaagaacggtggagttatgtctgcaatggcacacttgaaggacaggaaaaatttgcgcagcgcttccttgacgaagcggtggtaagagagcagcccgcgggaacctatttgtgccgccagggagatcctgcggcctgcctgtatctgctgttggacggcgtggtggaaaacagcgtgatactggaggacggcaggaagaagatcaatatgctgtacaccggaatgagcctgctgggcgtttcgtgcctggacgaggaggtttgcatggtgaacctgcgctgccttaccagagtgagaaccgccagagtccaccggcaggcggtccgggcctggccgccggagatgctgctgccggtggcaatgtgccagacctacaagatgcagggcgtgtaccggcagctgcgggaacaggtgtttctgtctacggaggaacatctattgaaaatactggaggatttggaagcgtcgggagccctctccggcgaatatgggctcaaacgggtgagccatcagctcctggccgatatggcgggactctccagggtgcaggcgtccaacctgatcggccgtctggcggcccggtctttgctctcccggactcagctggaaatgctccgtctgggcggacaggaggtgagaaacgatggatgacgggcagtttacttatatgacggcggactggcttctgggtcacgagaaatttattgagaaatttctgcagacggcggagatccgtttcctgaaaaagggggatattctgatccggcagggagagccggtggatcatttgtacctggtgctgaagggatcggtggaatcctacttcgaaaatgggagcggaaggcagaagatcacatccatctgccagcggggagtcctggttggcctgaccggtttaaacgactacatggaacatcacacgatgcgctgccgcacctccgcgattgtggcggtggcgcccaaggagacggtttaccagtgggacagcgagatgctgatggctctgattcagatgcagacgcgaaaaatgaaaacagcctttgcccagatgatccaccaggtggcccagaccattgaggggcgcattcttcgcttgcttctggaggcggccagcgaggatgaggcgaaggagtacgaaattccggtgaacatcgtattttcccgccaggagattgccagtattgtgggctccacccgggagcgggtgggacaggtgctcaacgagctgcagaatgagaagctccttgagatcgacggcagagatatctatttttacccctccgcgctgaggcggcggctggaacagctctgacatatgtttgaatcccctccgggcaaaaatccggcggggatttttgaaattcagcggaaatgtgaaaaactttacagcttttgtccggagcatgcagtatgattcttccagaaacgccggtgagacggcaaaatcaaaggaggaatgaagaaacgtgaatacgaggaaacaaacggcccggcccgggggaacggacacgcagcggccaggaatcagcggctttgtggccctgattctgtttatcatggtattttcaggggcactgaaggatgtgcctgtgctgaaagccctggatttcaacaatatgatgggggctttcggcgtggtgaagggagcggaaggaaactttcagggagtgggaggcgtgggagccaaggacggcttcatggtcgctttcgcccagctgccccttctgatgctggctatggggattgtggagttggccactaagtaccgggcgcttctggcggccaaggtattgtttacacccattctgaaaccgcttttgggtataccgggggcagcgggtctgacgctggtatcgtccctgaacagctccgacggcggggcggtgatgacggcggacctctacgaccggggatatctgacccaggacgaacggactattttcgtgggcttccagttcgccgcttccggcatgatcgtggcgacggtgacgctgctggccatggcgcccatgctggtggtctctcccatgttcatcatggggattctgctgctcatgaaatttgtcaacggcaatctggtccgtctggcggtgaagcgcaggccctcgtcggacggggagaaccgggacgaacgcgctgcgtaaccaatgtggaggcaaacaaggaggaatggataatggaagcagagaatacggcaaaaaaatcgtttgtggaaatctttatggaaggggcctttaaagggtggaatatgggaatccgctccatgctgaccgccctggttctggcctatgccctgatgtatatgttgaaggcgtccggggccatgattctgttggagcgggtattctcgccggtgatgggactgttctccctgccgggagtggcgatcaccgcgctggtggcggcgctgatgagcaagccgggcggcgtggccaccgcggtggccctgtacacccagggggtactgacggacgtccaggtgacggttatgttcccggctctggtgctgatgggcgggctggtcagccagtacgtgagagtggtggtggtcagcggcacggacaagcgcaggcattcgcttttgatcgccagtaccatcggcgtggcggtgctgtcgattccgctgatgaatattctgctgggcatcatgcgccggtaaaaagggaaaaggaggagcagtatatgatcaaacgggaagccattgcgaaacagttttacattgacgatcacgcggtcgtctacggtttgttagccaaggccgcggatcagctgtacggggagcgtgggatgaaagccagtgccagggccacggttctttacgcttgtgagcgcggccggagaatggcaaagcgggcgtccagggacggatatcccctgacgcctgccgtataccggatttatacggagtgggcggacgagcagaagcggatgaaggtggaaacgcttcagctgtcgccgaattaccggatgaacggcacctactgcgtgtggaatgaaacctggaaacaacatcatttggaaaaatatggagaaatctattgcacctacgtggacaagaccatggtgaaagcgttcaatcccgggaacgagctgatcattcacagcgcccagtccctgggagggccgggctgcgattttgagtggccggggctgtgttatgaaaacgaggaggcgctgagggcggacggggccttaaaacaatccaaacgccaggttgcggtgaaggatttcctgtaccactgcggccacacggtttccgccatggggcggggatatgcgctggagcttgggcaggagggatcggaccggatcgtgtgccaggccctggaggaatactgcgccctgttcggcaaggagaaggcggaagccgtgatccgggaatcggaacttgattttgaggaaatataaaatggaaacggtgtaaaaaagggggaaatgggaagtgacgcaagagtacggtaagattgccaacgggatcgtcctgtggctggcctgcgcgccgggagtgctgtgggtctgcgcggcggcgggaatattcctgaggaggagtttgaaggacggggccaggatggggctgaccagggaacagatacgcaagggaatccggggagcttccatcgcctccgtcggcccctgcctggtgatgctctcctccatgctttccctgatggtgatcacgggcagccccattgcctggctgagggtcaatgtgatcggcggggtggggtatgagatcatgggagccagctttgcggcggacgccatgcatatcaaaatcggcacctcccagatgagcgtggattatctctgcgtggccaccgtggtgatgaccacgggctgtctgggctggattctcttcggcgcgctgttcagcgacaagatggacaaggtaaaccaggttatggccgggggaagcaaggctatgattcccattgtgggagcctgctgcgtgctgggctgctacagcaacctggtgttggagcgggccacgccctttgggccggggacggtggccgcggtgagcgcaggcgctctgatgattctcatccagctggcagccaggcggtggaagaagcgctggctgaaggattgggccttgtccattgccatgattgcgggcatgatcgccagcatggcggttcactagagagggaggtgtttggttatggatcgatccgacgtctacaatcacagttatatgccgtatatcgtgaaatggggcaagaccgtgtgctgggtcctgctgccgctgatttatcttcccaccatcgcactgctggtggtttatggggcgaaaatgccccttgatgccacggttaacgggatcattgccattctctccgccagttttgcggtgtatctgtcggaacccctttccgttttcccgattctcggaactcccgggttatacctgatctgcatctcgggcaattccaagcagattcgggtgccggcggccctgatggcccaggatggggccggggtggaacagggaacgccggagggaggaatcatgtctagcatcggcgtggcgacctccatgttcatcagcattctggtgatgacggtcatgatttttatggggaaatggattctgggcgcgctgccggacccggtggtggccgcgctgcccatgctgcttccggctctgttcggagcgcttttagcccagcagctgatgaatcatcccaggctgggggcagctgccgtcgcgcttgctgccgcggtgcgtctggcccagacccggggaatatttggaattctgccccttggcggcggatatgcgccgatgttgatctgcgtgtttggaaccattggtctggccaggatcatgtacaaaatgggctggctgaaagaagataggagatagaggatgagtgagacaataaataccaggcggatactggagctggtggaggaaaagaaagaacagttcataacgctcagcgatgcaatctgggccgtgccggagctggggctggcggagcaccggtccgccgggctgctgattcaggccctggagcgggaaggatttcaggtggaacgcgggatcgacggcattgagacggcgtttgtcgggacgtacggcagcggccggccggtgatcgggctgctggcggagtacgacgctctgccgggtctgagccaggaagccgcctgcacttcccacaaaccattgtcggagggagaacccgggcacggctgcgggcacaatgcgctgggggccggcgtagttgccgccgccgtggcggtgaaggattacttaaaggaacatcccggagcaggcacggtgaaggtgtttggctgccccggtgaggaagccggatggtcgaaaatgtttctggcccgggacggctatttcaaggatgtggatgcctgttttacctggcatccgggaaactgcaattcggtccagggctacagctccaacgccaatatctgcgtatattttaccttccgcgggcggagcgcccacgcggcggcggctccccatctggggcgcagcgccctggacgcctgcgagctgatgaatgtgggcgtgaactatctgcgggagcatgtgcccacggaggtgcgcatgcactatgcctaccagaatgcaggcgagaaggcccccaacgtggtccacgccaacgcctgcctgaagtattacatccgcgcgcccaaaatggctctggccgtccaggtattggagcgggtgaaggatgtggccagaggcgcggcgctgatgaccggcacggagtgcgacatcaatgtgacagcgggaatgagcgacttcatcgccaacgacgcgatcagccgcttgtttgtggaggccttcaatctggcggggccgccgcagtttgacgcgcaggacgaggcgctggcaagggccttctgggatcagtattctgaaaatgagaaggccgccggaatgatgcggatcaacctgtcgtacccggacggggagaagttccgggacacgcccctggtaaaggaaatcggaccctatttccgaatcgacaaatatatgccgggctccaccgacgtgggggatgtgagctacgtgacgcccaccggccagctctgggtgacctgctacgccaacgggactccgggacattcctggcaggtgacctcccaggtggcctcctccatcacccacaaggcggttgtgtgcgccgccaagacgatggctctggccactgtgatggccttttcgcagccggacgtggtggaacaggccagggaagagctgaagcagcggacgggcggcgtctacgtctgtccggtggagccggggaaaaagccggttatgccgtaaaacaataaagaggaagaaaacaatcgcccgcaggctgcgccagcggcccattgcattcaaggaaagcgcctttgagcggctaacgctgcaaaaggcgcttttttggctgccggacataagctggcacggcgaaacttccgggattccttgttatttcccaacaaaaatgttaaaatttgtttatacactgacagacaagacggggaggtaaaccgatgcgtggagagaacaatacaaagcgggggatggtccgcggcagcctgtttgagacggtgctgcggattcttctggagcagagcgggttttcactggtccggccgggggcggaacatgcgggcaaggtgcgcatgaaccgggcgaattttgtggagctgaagggccggggcggatggcaccagatcgactgcccttttgattacgacggttttatcccctttttatatccggtgcggcttctgggggaggcgaaatttctgcagaaagaggtgcagaagaactcgatccgcagcttcatcggcgttctgaaagacatacaggaaaattattttgtggacgattccctgacggactccatggtgcgggggcgcaggatggagcttggagcgtttttcgcagccaacgggtttaacccggaggcagaaaagctggcctatgcccacggaatccggaccatttcctaccggaacaatctggccatcgcggatatcaaggaccggattcttctgctggaggaacgttacatatcctccgccaagctctccgagagcggcagaggcggcaggaaggatttcatcgaaaaattcgagatggtgctcagaggtgagaaaacgggcgaggagttcgcctgggattttgacctgcagcccagcgcgggacaggcattggaggagctgggggatttcttacgggagatccgcaccaattttctggcctccacggacaccggggtgctgctgcattttctgggggaggaacccttcccggaagaattgttcagccaaagcgacgaggcgcgctgccgggtccgctatgttctgacgggacaggagacccggttttatctggtattttccggggacgaacgggaacggcggttttattttactccgccggactccctgagcgaggcggctctgttcggaggaaacgtcctggatgaaaaggagcgccatttaaaggtactgcacacccagattatgataaaaggcctccggcgcagcctggacatcaaactggaccaggactggctggaagccaggcgggaactgaacatgaccccggaaacgttctaaggaatctcagaacaccccctgcaccaacaccatatagcacaccgtccccagcgcaatgctggccagggtgttccccttccacaggtgcaggattaccacaagggccacgctgataagctccggcagcccgtatgggtaggcgagcggcgtgacgccctttaagcagtaaaccaccagcacggccatgatggcggcgggcagcaccgcgcccagatagcgcacgatccgcggcacctcctttttgccgccgaagagcaggaaggggagccaccgggtggcctgggtacagagggcgcagatgatcacagtgatgagtacatatttttccgtcataatgatgaatcctccattttccgttcaatgatccggcgggagatgagcagcacgcccgccacggccgccagggccggcagaatgaagttggccgagcggatcagggccagaaagacgatgccgcaggcaaatcccgtcagggcgggcaggtgggttttcgcgtgcttccactgatccacgcagatgaccacgaacagcgcggtcatggcgaagtcgatgcccgtggagtcgaaggcgatcaactgcccggccagggcgcccagaacagagcccgccacccagtagcactggtcgaacagggagacgaacagcgtggccatgtcccattcccggtccgtgaagtcccggggcctggccatggaacacagcagggagtaggtctcatcggtcagggagaataccatatacgggtaggcttttttcatctttttaaaacgctcgataaaggtcaggccgtagaatgcgtggcggctgttgataaacaatgtcatcaccgcggtggtgacgaagctcagtccgccggtgagaatgcccaccagagcgaactgcatggaaccggcgtagacgcaggcgctgatgagaaaggcccacaggggccccaggcccgccttctgtaacaccagcccgaaggcgatgcccagaaacacataccccagcatgatggggatgctcttgacaaatgcaaattttgctgcttttttcataataactcccgctttctgtttccgcttttgactggaatatccagtgcggccgccggtatacccggaatataggccgtaattagaaacagtatagcaaaatttgccatgaatttccaccggatttttggtcctggcggacatggggcggccggatcgggggtttacagtccggcggcatttgatatataatagcggtcatgagcagatccggacagtgaggaatcgatctatgaagcagtcgacaaagaaaatgttttcgggaatcggcattgcggcctttgtgatggtcgctctggttctcgtgtatgcggttttattttaccgcacgtcccaggcgaagatggtcagcacgctggccgagatatccgatcagagcgccaaggtggtccgccaggaggtcgagaagaaccagatgatgctggaaagtctggcgatcctgctggcccagggccactccgaggatatccgggagctggtggaggaactggcggcggtggatcgggccaacaacttcaagcgtatggggattgtgcgggaggacggaaccggctacgccaccgacggctcggatgtgaacgccaggtccgcgctggtgagagagcgctttaaaacggcgtttgccggcagagcgtttgtgtccgaccgggtgtccgatctgatcgacggagagccggtgaccgtgtacggcgtgcccttcaccgccggggacggcggcacgtacgcgctgttcgggacgtattcaacggaattttacgaggacagtctctctgtctccaccttcggcggcaatgggtacagctacattatcaaggaggacggggaatgtgtcagcagctcccgcaatccggccagcctggggaatctggacaatttttataaggaggtaagcgccatctccgattccaacgcgcagcagatgaacctgctgcgggaggagattgcggcccacaaaagcggatctttgcgatacgagcgggaggacgggcggcgctacgtctactaccagcccctggaggtgaaccagtggtatctgctcagcatcgttccctcctgggtggtggaggaaaatgtcaacggcatgttgagcctggcctacaccatgatggccgcctgcctgggcatactggccctgatggcgtaccagatctggacgattaagaaacgttattgggaaaaagtggaagatacggcgctgacggacgcggtcaccggccatgcctcatttgccaaattccgcctcgacgtgcaggaaatcctgtccggttcccgggacacgccctatgcgctggtctgttttaacgtgcgtatgtttcagtacatcaacgacctgcacggctttgccgagggcgatcggattctaagggtgattgcggactatttaagcgcccacatcggcaggcaggaggcctgcgcccggttaaacgcggaccgtttcgccgccctgttgtcctatcgggacaaggaagagctgcgggggcgcgtaaagaatatgatccacggcatggaacagctgaaccggagccagatggaggagatggcctacgacgtccggatgaccgccggaatttatcagatcgaggacaaggcggaggtgctcgataagatgctggactgggccaaggcggcgctttccagggaaaatatgggagccattgagaactgcggtttttacgacaccgggatccgggaacggatggtccgccggaaggagctggagaaccattttgaggaggcgatgagccaggggcagttcgaggtctattaccagcccaagtacgacgtgaagggcggccgcttttacggcgcggaggctctggtgcgctggaactctcctgtggagggcatgatcccgccagggctgtttgtgccggtgttcgagagcaacagcatgatcatccggctggatgagtacattttcgagcaggtgtgccgccagatccggcagtggctggaccgtggtttcgcggtgcagccggtttctgtgaatatttcccgtctccacctgtaccagaaggggtttgtggagcgctacctgggcctgatccgcaggtggcacgtgccgcctgggttagtggagctggagctgacggagacggtgatgttcgacaatgaagaactgctgggggaaacgctgcagggtttccggcgggagggcgtgcccatcctgatggatgatttcggctcgggatactcctccattcagcttttgcgcagcatgcccatcgacaatctgaagatcgacaaagggctggtggacgactccaccgagcggcccaagcttcagaaaattctctccagcgtgatcggcctggcccagtcccttcatatccaggtgacggccgagggggtggagaccaaggaccagtacgatctgctcaagcgcatgaacgtggattacatccagggctactactgcgccaagccgatgccatgcggcgaatatgagaaactggtgtatgaaaataccggcggccgggaagtattttaaaaaatttcccggcctcccctttcccggaatggagaaatgtgctatgatagcagagtatacgcctgtccgcgccgggaatacagcggagcagggaatcagataacggaggaacagtttatggcagagaaagataccgtaatggaaactgaggagaaagaggtggtttccaaaaacttcattgagcaggagatcgacaaagacctggcgagcggagtatacaaccacgtccaaacccgtttcccaccggagcccaacggctatttgcacattggacacgccaagtccattttgctcaactacggcctggcccagaagtacggcgggaaattcaatctgcgttttgacgataccaatcccacgaaggagaaaaccgagttcgtggagtccattatagaggatgtgaagtggcttggcgccgactttgaggaccggctgttcttcgcctccaactactttgagcagatgtacgagtgcgcggtgctgctgatcaaaaagggcaaggcgtttgtctgtgacctcagcgccgacgagatcaaacagtaccgcggcgactacaacacgcccggcaaggagagcccctaccggaaccgcagcatcgaggagaatttacagctcttcgaggagatgaaggagggcaaataccaggacggcgcaaaggtgctgcgggccaagatcgacatggcctcccccaacatcaacatgcgcgacccggtgatctaccgtgtggcccgcatgtcccaccacaataccggggacaagtggtgcatctaccccatgtacgatttcgcccatcccatcgaggatgccattgaaaatattacccactccatctgcaccctggagtttgaggatcacagaccgctgtacgactgggtggtgaaggagtgcgggtttgagaatccgccccgccagatcgagttcgccaagctgtacctgaccaacgtggtcacgggcaaacgctacatcaagaagctggtggaggacaagatcgtggacggctgggacgatccgcgcctggtttccatcgcggccctgcgcagaaggggttacacgccggaggccatccgcatgttcgtggacctggtgggcgtttccaaggccaacagctccgtggactacgccatgctggaatactgtatccgcgaggatttgaagcttaaaaaggccagaatgatggctgtgttggacccggtgaagctggtgatcgacaactatcccgagggccaggtggaggagcttgagatccccaataacctggagaatccggagctcggcagccgtttggtgccctttagccgcgaggtttacatcgagcgggaggacttcatggaggagccgcccaggaaatatttccgtatgttcccgggcaacgaggtgcgtctcatgggcgcttacttcgtgaaatgcacgggctgcgagaaggacgaaaacggcaatgtgaccgtggtgcacggcacctatgatcccgagaccaagagtggttccggcttcgagggccgcaaggtgaagggcacgatccactgggttgcggtgcccaccgcgaagcaggtggagtgccgtctgtacgagaacatcgtggatgaggagaaaggcaagctgaacgaggacggttccctcaacttgaatcccaactccctgatcgtgttaaaggagtgctatgtggagccggagctggcaaaggctcaggcttacgacagcttccagttcgtgcgcaacggctatttctgcgcggactgcaaggacagcacgccggagaagcccgtgttcaaccggatcgtatctcttaagagctccttcaagctgcccaaataaccagaaaaaccagcaataacccgcaggctgcgccggcggggcatcacattgaatgagaaccccggcggaagcttcgctcgcaacgcgcagagctgccgccggttttttcgttgggaggaggaaaaaatggaattgatggtgccgctctacgctcaggacaagcgcccgctgtacgagcagatttatcagtatattaaggatgagatccggggcggccgcctgacggccgggagccgcctgccctccacacgggtgctggcggacaatttgaaggtcagccgcagcaccacccagatggcctatgagcagcttttgtccgaggggtatattgaggcggtgccctgcagaggctattttgtggcaggcatcgaggagctggtggaggtgaagggtcaggagacggggagttttgtgccggagcctgcggggagccgcgagcagtaccgggtggatttctcacccaggggcatcgatctggacagctttcccttcaatacctggcggaagatcagcaaaaacacgctggtggacgacaataaggagatgtttgcgggcggagatccccagggagagcggtccttgcgggcggccatcggcagctacctgcactccgcccggggggtcaacgtgaggccggagcagatcattatcggcgcggggagcgagtatctgtggctgctgttatcccagattctgggaatgaatcacaagatcgccatggaaaatcccacttacaagcaggcttaccgggtgtttaacggcatgggttatcctgtggttccggtggagatggaccgctatgggatggatgtggcccagctggaaaagagcggcgcggatgtggcctacgtcatgcctgcccaccaataccccaccggcatcgtgatgccggtgcgccgccgccaggagcttttggcctgggcttgcggcggggagagcaggtatctgatcgaggatgattacgacagcgagttccgctacaagggaaagcccataccggcgcttcagggcatggacacggccgggcgggtgatctacattggcaccttctccaaatccatcgctcctgcaatccgcgttggtttcctggtgttgccgcccgctatggtggcggtttaccggcagcgggcgggattttacgcctccacggtgtcgcggatcgaccagaatattttgtaccagtttatcacggaaggccattatgagcgccatctgaaccggatgcgggcggtctacaagggaaagcacgacgcgctgttggccggtctgcgggaattggaggaccggtttgagatacgcggcgagtacgcggggctgcacgtgcttctgacccacagaggcggcctggacgaggaggagctggtgcgcagggctgcggatcagggggtcaaggtatatggaatgtccgggtgttttatccacccggagcacggatgctgcccctccacggtgctgctgggttacgccagcctgaccgaggcagacatccgcctggggaccggccttctgcgggaggcctggggagcgtgaccgtgggaagcggtggattgttgcaatgacagagaggacggacagatgattcagaagagacagatgatagccgcggcagcgggcgtgctgctgggctacggcatatgggctgccgcccagaatttcggaggaacggcggacggcggtgccgggaacacgggatatggaaggatggcggacgccggaggcggagccggggcagccggaaacacgggggccggggcgtccggcggcttgggcgcggacggaacaggcggcgcggacgggagcggcttggcgggagcgggccaaagcgcgtccggaggtatggattcctcctcccgatccgaggcgccggaattaaacgagcaggagcgggcggcagtgcagcggctggctgcggcggtgaaaagcgggaataaggagcggattgcctcagagctgctggcggacggcgacacactcagctggctttactatgagacgtttggggaggagcggtaccgctatgacgggacggaattcaggacggatctggccggagaggggatggtgctgaccggcgcggccagcgttttctacggaagcttcggggaaaacgggccggaaggccgctgtacggccttgcaggcggtggagctggaaaagccccgatatgattactcggagggaatctggaaggacgggcgcatggatggagccggggtttccggctaccgctactatcagggcccgccccagggcgaagccgaggagatccgcagggagggacggtttgtgcgcggcaagatggaggggaccattacctaccggaacaccggctccgacggggtgacggccacctacaccatggaggtgaaggagggcgtgactcagccggacgaccgctggatcccaggcccggaggagggcgtctaccacctggaagccgacgacaatccggcctacgcctacgccctgacggaggaggagatgaagcagccccgatgggtgaacctgctggtgtgggatgttgaggaatgagcggctggggtctattctatccaacaaaaacccccgtccttatgaaagacgggggtcacgattgtacaagttgattcagcggtccggtccgcccgttgcgggcggcgaccgaaatctgccggtttcttcgcgggtaaggcatgggtatcgcgaggaaccggcattttccctgcatagaatcccatattttgggaaaaatcagatcgtatcttcctcgatggtcaccttctcagcaccggcggtctggtccggctctgcgggttcttctgcgggagcgggttctactgccggggctgcgggagcgggcgtctcctcgggaagcggtttcttccaggcgggaattccatcgctctccgtgcgggagtagtcgaacagatcgtcgtcgtccacgtaatcgtcgtctaagaagccctcgtcctcaaacagctcggtatcttcttcctcgtccatcgcctcctcaaattcggagcgcttgttcttcactgcggtgagcgcgatgtgggcggtatctacggctgcggagacagcctcgtgggcagtgtcggaaatgacggccccggcgtccttcagcacgtttttggtggcttccgccatgtccttagccgccagcttgaattcatccttgctggcgtgaagggaaatataattgcggtcggtgcggcgcggatccacggtgcggtcctcttcgtcctcgccggtttccccttctccgtcctcaaactcacggaagtccttctccagttcactgtggaacgttttgtatcgaagcgcgtaggagacgctggccgctacagcccctgtgactgctgcgaatgcgatcaatttcccgaatcccttctttgccatattgaaaacccctttcactgtgattcagtctttgttatacgataatgcattagtattattgtaatacgaaagcagaaaaaaaggaagggaattgcaggaaaatgtaaaaaaaaaataaaaatctaagaaaattagcactcaactcttgacagtgctaataactggtgttataacatatgatgtgagtaaacaaaggggttgcacaaacctgaaaaagaaaaaacagaactgattgcaaggaggaattcatcatgaagttagtaccgttgtttgacaaggtagtgttaaaacagttagtagcggaagagaccacaaaatctggtatcgtgcttcccggcgcggcaaaggagaaaccccagcaggcggaggtgatcgcggttggacccggcggcgtgatcgaaggcaaggaagtgaccatgcaggtgaaggtaggcgacaaggttatctattccaagtattccggcaccgaagtggagatcgaggacgacaagtacgtgatcgtaaagcagaacgacattctggctgttgttgaataatctgtcaatcgtatcggttcagcaccttcacagatacgagcaaaaatccatttaaaatcgacttcgccgatgggatttttgcctgcaagcttggggttcatacggtcagcgcagtaagtgcgcagacctgctgaacagttaccgtcaatcattataataaatttaaaatacgcgacatagaaaacaatatttggaggtagatgagtcatggcaaagaagattaaatatggtgtagacgcccgcaaggcactggaggccggcgttaatcagttagcagataccgtacgcgttaccctgggaccgaaaggccgtaacgttgtgctcgacaagtccttcggtgcgccgcttatcaccaacgacggcgttaccatcgccaaggagatcgagcttgaggatccctttgagaacatgggcgctcagctgatcaaggaagttgcttccaagaccaacgacgtggcaggcgacggaaccaccaccgctaccgtgctggctcagtccatggtacacgagggcatgaagaacctggctgcaggcgcgaaccccatcggcctgagaaagggcatgaagaaagccaccgacgctgcggttgaggccatcaaggagatgagcaagcccatcaacggcaaagagcagatcgccagagtagccgcaatttccgcttccgacgacgaagttggaaccatggttgcggacgcgatggagaaggtttccaaggacggcgtgatcaccatcgaggaatccaagaccatgaagaccgagctggatatggtggaaggcatgcagtttgacagaggttacgtttccgcttatatgtgcaccgatatggataagatggaagccaacttagacgatccctatatcctgattaccgacaagaagatttccaatatccaggagatcctgcccctgctggagcagatcgttaagaccggtgcaagactgatgatcatcgccgaggacgtggagggcgaggctctgaccactctgatcgtcaacaagctgagaggcaccttcaacgtagttgcggttaaggctcccggctacggcgacagaagaaaagagatgctgcaggatatcgcaatcctgaccggcggtaccgtaatctccgacgaggttggcctggatctgaaggaagccaccatggatcagctgggacgcgcaaaatccgtcaaggttcagaaggagaacaccatcatcgttgacggctttggcgagaagagcaacatcgacgccagagttgcccagatccgcaagcagatcgaggagaccacctctgatttcgaccgcgagaagctgcaggagagactggcgaagctggcaggcggcgttgcggtaatccgcgtgggcgctgctaccgagactgagatgaaggaagccaagctgcgcatggaggacgctctcaacgccaccagagcggctgtggaagagggaattatcgcaggcggcggttccgcttatatccatgctgccggcaaggtaaacgaagtagtagagagcctggaaggcgacgagaaaaccggcgcaagactgattctcaaggcccttgaatctccgctgttccacatcgcagccaacgcaggtctggaaggctccgtgattgtgaacaaagtaaaggaatcccccatcggcacaggattcgacgcatacaaagaagagtatgtggatatgatcgaagctggcattctggatcccgccaaggttaccagaagcgctctgcagaacgcgaccagcgtagcttccaccctgttgacaactgagtccgtagttgctaatattaaagaagcagctcctgcacccgcaggcgcaccggacatgggcggaatgtactaatcagataaaaaccatgatatcagggcggtccgggagcagtaaggctcaaccgggccgcccttttgtggttttccggtccgtgcaaatgtcacaacataagaaggagaaatgcaaatgaacgacgacgcatacgcagaatggctggtaaagcgcaaagatccgatctacgcggtccccgtgaagattctcatggcggtgctgtgcctggtttctctgctgatcgccatgcagaccgcttttggtgcgatcctgttgatcgcggttggaattgccgcctactttgtgtttatcaacctgagcgttgaattcgagtatctggtggtggagggagatgtctccattgaccggattctggcccgctcccgccggaaaaaagttctggattgtaaaaaagaggaaattcagattgtggccccgtcggattcctatatgctgaaggattacgagaagaccggaatgaaggttaaggactgcacctccggacgcaatgggtccaagacctacgcgctgatctatcagcagggcgccgactgcgtgaagattctgtttgagcccaacgaaaaaatcctgcgcgcgctgcgccacagcgtccctggaaaactggtgaggtgacgtttcgtctgagacaatattataataggaagaaagtccgttcaaccgcggtgtgattttgaggaagcacgcgcggggggacggattttttttgcctggaaatggtatcaggtgaatttttacgaattctgtaaatgtaaccggtttgtaaccaatatctggtatagtagaatcatcagattcgatatttaggaatttttggcagttgaagtgagagaggagatcaggtatggaaagacgaacaagaagagggacgtttaccagaaatgcatacagcgcccggaaacgattgttggccttcctgttggcggcagcaatgattctgagcaatgttggctcgaatcttaacgtggtgtttgccggtaccagcgagccggtggtgtttgagctggccggttcagagctggtgcgtgcgattgaagaggccattgccggcggcagcgaggtgacaagggaggatctcgacttcaccaatggtaaggtggagcagtttgagaaactcttttttggagagggaaaactatacgaagcgtaccctgaaattgacgggggggggggtattgattcagagctgagaatctttgtccgccttcccaaagacgccgacgacatgtatatggtgaccggcgacgaggagattttgttcctgtatatcaacaacggggatgagacgattcgctgctctaccaatatcacacgtatggtagacggcgaggagaaggtgaagaagacaaagagcgttacgatccgcagctatgaatctgcattcggcgatgaggaagttaatgtaatcccggatcagccaaagcaggatgtaaacgaggcgacttcttccactgcagataaagaaatcacaaattccaatgaatcgaatcagacagaaaacaatacggttcccgaagagaatcaggaaaccggcagcgcaggacaacatgatcctgcaaatgataacaacgccgagccggaccagaatgtaagcgacggtcaggatgaggtccaggctccgcagaccggcggggaggaaacgcaggaaaccgccgatgcgccggcggacgatgcacaggttccgcaggaggacagtgcggtcggtccggataacgaaacggcagcgtccgactctcaggaggaagcttccgagccggaagaagcggctgaaccggaagaagcaactgagccggagcagagcgaagaagcaggcgagccggtggcaaccgtgacacggcactacgctcccatcgtagcggaaaacgaaggcggcgaggcggcgtctgcggatgacagccagaaagaacaggcggcggaagcgccggacaacagcggcgaggtggaaacgcccgcagagggaccggcagctcaggaagaaaacgagaaagcgcctgaggcggcagagccgaatggggatgcccccgcggcggatgtccctgtagtggatgctccgacggcggatacagctgtgtcggatgccccgacggtggatacccccgtagcggatgcccccgcagtgaacaccccggtagtagataccccggcagctgacactcccgcagtggataccccggcaggtcagggtcccgcggcggattcggaagcgacggttcccgacgggaatcccgcaccggaagaaaacgcaccgcaggaaccggccgacgagaaccccgcgcctgcaccggatgccggtgtgaacggtgaaggccagaccgctcagcctgaggaagagcttcccaaggagtcggttgtgacgattattccttcggcgaccccgtccgagggaacgcaggttaagccggaagagcagaagcctgaggataatgttgcggcggccggaacctccgatctggtgggaatgggatactgcagcacggcgaaggtgtattccgccacgttgaaccagctgaaagcgctggaagatttcgaaggatataaggtaacatacgatatcgcgcctaaggccagcgccaggattgccgatggccccagaggtgttgaagagggcgggaccctggtattcggtgtcaagaaccagatcggatatgcgatcggtgctgtgaccgccaacggcgaggcgctggaagccgactccgtgacggacaatgacgacggtacccagacagcctggtatacggttgcggaagtaaatgaagagcaggaagtagcggtgaccatggtggaaaccatgcctcacccggattttgacaagaccgtggtaatcgacggcgtgtccatccatgtgacggcgcccgacggcgtgcttcccgagggcacagagcttgaggtacaggaagtaacggaaaaagtagcggaagctgttaaggaaaaagtcgaggcccagtccggtgagaccaccacagtgaacgcggttctggcgtacgatatcaatctgacgtttaacggcgtcaaattagacaacagctgggcgaattccgaaaacagcctggtcagcgtgacgatttccggcgagaagatccggcagaacagcgctgagtcggatacggtcgagattcttcatatgaagaccagagaaacggagacggttgaggcgttgtccgccgaagtagtgatggaagcggagaaggcgcagaatgagggcgcggaagagattgctgaaaacagcgaggccaagaccgtagttgaggttccgaagctggatgccgtgacggctcaggaagtgattgtcgacagcgagggaagagcagccatcgatgtggcggatcagaacggcatccgtcaagtggagtttgcaacggaccacttctcgatctttaccattacgtttacgcagtcgtccgtcagctacaccataaaagcagagctgaaggacacaaaaacagctgatgtcgttgacctcggttcggacgcgtttcttggcaagttgggtaaccgggaacgggtggacgtcaaaacacttttgaagggcaatgtcaaggataccaatacggatgtaaacggcgataagtaccggtttgtcaaagccacagcaacggacaattttgaaagcggcgataaaatcgtcagcctgttccgggacggcagcaagctctcttactttgatgtcagcggcgagcagcacatgctggaggtaaccgggaaccgcgaggtgaaaatttatctgtggtatgagcgggttaccggcgaaaggccggagtatctgacggttgagttctaccaggatgatttgggcttttccaagtacgaccattatccgaactatgattgtatcaataatattgtaggttcgggttcggatcaggatcagcctcgcaatatgcattatgtgatcgtaaaaaatatgggcaacggcaagaattatgatctaaacgcgctggtttatgtgcggtgtgatattttccatgagctgccggaagagccggatgatcagaaagatacgtttttggtcacatacgaagatgagaatggcgatgtcctgggatatgaagtggtggagaaaaatttgactcccaagcatgtcccgtccaccacgtcaaaccagcattggacgtacaaaggttccgactccccggttatcccgggccaggagcgcatcaccacaaacgtggtctttgtccgccatacagttgaagtaacgtacaaggtgacttaccatacggacggagcttcccattccaacaaaccggtagcaccggtggatgagaacagcccgtatatggccggttctaccgtgacggtgatggacaacacaaatcttgtgggcaataacgcgcatggcggaaattacaccacggatttcatctgctggaccacggaaaagtccaatgtaaactccggcaggaacaacctgtactatcccggagatacgtttgacatcactcaggatatggacttttatccggtttttgtcggcaacagaaaggacgtccgcacgattgagtttgtagcggataccaacgggatgctgtcgctttccggagaaaccgcgggcacttttgcgttcccgattatcagcggttccgagttcggcaaagtgatcgcctccacagcggatataccggtgcctgtacctaacgacacctaccgctttaccggatgggagatcgttgttaatggccagacccgggagtacagcgatgcagaggccattttgagccattacgcggacctgccggttgaaacggatttgacatttattgccaaatttgtgacggtaaatgattccacaatcagcgtatggttcagcggcacaaacttaagagacggatttgacggtaaggaaagcatttatcctgacaatggtatttccggcgacagggagtgggttggaaatatcaatttgagcaaggcactgccgggcggttccgaccttccctatacgttcgcccagatcggcggctatgcccaggatattctggacatttaccgcgcggagattccgccggagcggattattgacggcaaactggatttgaaatatgccgggcacattgaaatatgggaagtggagtctgggaacaacgctgcgccgtgggttaagctttatgataccagcgagacggagcaaactatcaattttgaagatatcaagaccaagtcgggttatgaactcagataccatgtgtattttgagtcgccgattgtcgtgggcatcaattattataagctgagcgccgacggagcggaaccccaatatcccgcctccattcagatggttcccgggtatcattttacaggggataccattccggtgaccgacgagatggtgaactatattctggataaggatatgtttaagggctatgaattcagatacggctatcctgtcgtaggcgagtctctgttggtgcgggaaaatgctaggacaatccggctcttctatggaccgcaggccagaacggtaaccgtgacctaccatgacgataagggagcggagcttcagaaagcgcatacggaggacagctcctatggcagttcttatgatgtcggcgaccagatttttgacacattgaatattgacgatcatcactacgtcaaggagagcgtgaccggggaagtgagcggaaccgtgacgtccaatgtgacagtggatgtagtgtacgctctggacgacaagggtgatcatggcccagacggaacagcggataagtaccaggtcgaggtgacttacggggcggtgaacggaaccgtgagttttaacggtcccaagtacgtgacgctgtatgatgaaagcggcaatgaatcggagagcggaaccggacatctgagaagcgaacagatcccgaccacgcaggcgaatgaagggtatggaagcggacgctggagcccggcaaagcccactgtcaattacgaaattgagagcgcaacagaatttgtcgtgacgtacactcctcaggagagaaccgttaccgtaacctacagcgacgataacggtaaggcgcttcaggacgcggttacacggaataccagctataacagctcctatgatgtgagcagccagatttacgagtttttggatatcgatgggcatcactacatcaaggagagcgtgaccggggaagtgagcggaaccgtgacgtccaatgtgacggtggacgtggtgtacacgctggacgacaagggcgatcatggcccggatggaacagcggataagtaccaggccgaagtgacctaccaggcggtgaacggaaccgtgagttttaagggtcccaagtacgtgacgctgtacgatgagagcggtaaggaatcggagagcggaaccggatatttgaaagcagatcagattccagacacacatgcgggtgaagggtatgaaggcggaagctggagtccgaaaaaaccgaccgtcagctatccgattaaggctgcgactgaatttgtggtaacctacacggctcagaagcggaccgtaaccgttacctaccatgacgacaagggagtggagcttcgggaagcgtatacgctgaacacaacctatggcagctcttataatgtcggcgaccagatttctgacactctggacgttggggggcaccactatatcaaggagagcgtgaccggagaagtgagcggaaccgtgacgtccaatgtgacggtggacgtagtgtacacgctggacgatgaaggaaacggcgggccggatgatataccggataagtatcaggtacgttttgaatacaaatccgaagatactgcaaaactggtcctgagcggaactctggtggaatggcagactttcccgaaaaagggagacgagtacgataccacgcaaaaactctatccgagagttgcggtcacaaagaatgagcttggcggatatcattttgccgggtggacggacgaaaaaggcgaagcattcgaatcagatgaagcgctgcaaaatgccggttacaccacaagcatgatctttattgccggagctgaggaaaatgaaggcgttacgatcaactatatttcagaagatacagccaaaggaactgtgacgcttgacacagaatccgtgtccccggttacaggcgctcccaaaggttctgaagcgaaacctgccgacggttatgtgtttacccattggaccaactccaatggcgatacggtagccagcggcgagcagaacaggcactatacgccagtaaagaatataaaggatgatgtgttccaggcggacacctataccgcacattttgccgagcgtggagatctcagttacaaggttgagtattatttcgacggcaagcttggcgaaaccgtaagtcaggataatgttaagctgggaaccgccattccctatacgacgaccgagaaaacctttgggggcggcagctatgtatttgagagaaccgagggaccaaagacagtgggcggcgtaagcgccgataatgttctgaaggtttattacacgctggatgcaaccggaacagataagcccggtacgccggacggtgtgccggataagttccagattaccatccggtatgagtccaacgccaatggaagcgtgagcggaacaactgtggaggtccacacgattcaggattttgagcgcaatgcggaaaccggagagatcatcaaaatgggtccggtgaaaccggcagctccaaaagcagccgttaccgttaccgctaacagccgttatacattcagccattggagcatcagaggaaatgccgacaagcgttatggcagcacggaagatctcatgaaggatacctttgttgaggatgttacctttgcggcgaactttagcaatataggcggaggcagtcatggcggaggaggtaacggcggaggaaccggaggcggatcccatagcgccaaaaacgagaccggtggtcccggagcgctgacgaccattaccccggatgacgtaccgttggcgattctgccggatacaacggcggacctgacaatgattgacgacggcgaagtgccgcttgcggcgctgcccaagaccggacagggagccgtgaagggtacgcttgctatgatggtatcgggaattctccttgcattcgctgcggttggcaagcggagaaaagaagaagaaaattcctgagcaaatgaatcatcgaaataattgaatggaagacgaaagtcagtcccggccgtatagccgggacttttcgtatggcgcgcccggctggattatgtagaactttcagaaaaaaataaataaattgtaagttttattttgttttctttttaaatgtaaccggtttgtaaccattatctggtatagtagaaccagtacattggatgattggaattttgtgcggtaaaagtaagagaggagaacaaaagtatggaaagacgaacaaggcgcagagcgtttgccagaaatgtctatagcgctcaaaagagattgttggccttcctgctggcggcagcgatgattctgactaatgtcggctcagatctcagtgtggcatttgccggcaccagtgaatcggtggtatttgaactgaccggttctgagttggtgcgtgcggtcgaagaggccatcgccagcggcaatgaggtgacaagggaggatctcgactttaccaacggtaaggtggaacagtttgagaaactcttttttggagagggaaagctatacgaagcgtaccctgaatttgacggggggggggacattaattctgagctgagaatctttgttcgccttccggaagacgccgacgatatgtacatggtgaccggcgacgaggagatcctgttcctgtatatcaacaacggggacggaacgattcgctgctctaccaacattacccgtaccgttgacggcgaagagaaagtgaagaagaccaagagcgttacgatccgcagctacgagtccgcattcggggatgaggaagtaaacatcatcccggatcagccgaagcaggatgtaaacgaagcgacttcttccaccgcagataaagaaaacacaaataccgatcaatccaatcagaccaatgaaaatacgactcctgcggaagaccagggagccggcgacgcggcacaggatgagattgataaagaaaacgctgccgcaccggatcagaatgtaaccgacggtgagaacaatgcccaggcgccgcaggaagacgtcgcagcacctgatggcgaggcccagacgccggacgccggtaatcagggggagaacgctcctgaggcggatgcagcggatcaggcagccgagccggagggcgataccgcagaaccggacgcggcggacgtacctgaggaagcggcagaaccggaaggcgataccgcagaaccggaagaggcagccgagcccgaggacaacgtcgaacccatcgcttccgtgatccgccactacgcaccggttgtagcggacaacgagaacggcgaagcggctccggcggacgacagccagaaggagcaggttgcagacgttccggacagcgcagatcaggtggaagctcccaatgaggatgcagccgtggaagagccaaaagcggaagagcccaaggcagatgagcctgcggcggacgcaccggcagccggcgatacggtaacaaccccggatggaaatacagcggacggcgcagtgaccactccggatgaaaacggaaccggcgacgcggcaaccgccccggacgagaatgggaccggcgacgcggcgaccacaccggacgagaatggaaccggcgacgtgaccgctcctcaggagcccacagacgagactcctgctcccacaccggataccccggcagcaggggaggatcagaacaacggtcagccggccggaacgcccgacgcgaatcagcctcaggcgccggaagaagagctgccccaggaatccgtggtaacgattatcccgtccgccaccccgtctgagggaacggagcagaaaccggaagagcagaagccggaagacaatgtgtcggctgccaccacctctgatctggttggaatgggatactgcagcacggccaaggcatactccgtgacattaaaccagttaaaagcgctggatgattttgaaggatacaaagttacatatgatatcgcgcccaaggccagcgcccgcatcgtggacggtcccagaggcgtggaagaaggcggaaccttagtcttcggcgtcaagaaccagattggctacgccatcgaggcggtggccgttaacggcgaaacgctggaagcggattctgtgacggacaatgatgatgggtcgcagactgcgtggtatactgttcctgaggtgtatgaggagcaggaggttgtggtgacgatgacggagagcggcgagcatcccgaattctccgcaacccttcccatgagcgacggaacgattattcatttgtacgcggaggaaggcgttcttccggcaggcgtgaaggctgaagccagtgttgtgacgggaattgaagatgttgttaaggcgaatgtggaggctgaggctgaagcggctggggaagctaaggaagttgtaaaagtgctttcctataatatagatcttctggataaagacggccataagctggatgaccagatttggagcggctctgttctggtaacgttcaccggagcaccggttgaggaaaacagtaaagaagcagatagcgtagagatcatgtacgtagagaccaccaaggaaggcgaggttcaggccgatgtaactgccgaggatgtagtcgcggttgaagcggttgcggaaccggtggaagttgccggggatgagagcgttgattcagtggcgtttgaggcggagcatttctcgacgtatacaatcgtgtttaacaaaatgttgggaaccggtgagttaaagatacagcttgctaaatatgaaaatggcagagttgtcggaattggatacggcggttctagtggcaatttaagctatgatcagtggtatgagattgattatctcactactataattgaccttgaaggttatgtattcgaaaaggcaacagtgggcaacgagtatagtaataaaaatgtagcggctgttcggtttgatcgaggcagatttggagcttaccagttccaagcaagatttacagatgatagtgaagccaattttaataataatagtgcttcagaacaactgcatttttggtataaaattgcagattcaaaggtgacatttaaagcgggcagtatgggcggtatgggtacggaccaccagttgacatcttctaatggcaaagtgacgttgccgaaactggatgaaactggcctctccaataaggagggacgtgacttcctggggtggtctgtgagcattgatggaagaaatactttgttgaaaccgggagcggaatacgcggtaacaaaagatactgtgctgtatgcaatatggtcatatcaagtgacatttgaggccaacagtagcctttatggaaggggcgagtcttttaaggtcaatgttccggaatcgaaacgcattacaactccagataagccttccggttttacgaacagcagaggatggatgtttgtcggatggcatggcacaaaggaggggcaccataataagacggggttattgcagcagacctatgtaccgaatgtagagtatccgggtgagaagaccggacagataattgatagggatataacgctctatgcagtttggttaaacacgaatgttgacaataaggtgccggcggaattttatatcaggttggacggtgagatgccgtttgaaccccaaggatacgattacgcagggtacactgctcgtgataccaaaagtatggttggaacattacggcaaaagagagagattaacaataatacggaatgggtagcggcgaatatcaagacccagcctacagtagaggcaattaagaacgcaatgaagggacatggcggttttgatccgaatactcaggaagtcgtttggtatgtaataaaagaacaggaccaatggcatgttgatggcgttattaaggataaggaaaagcattggctgatttatgatcccaatggaggttcgagcccgccaaacagtacgcagcatactgctggtgatactgttaggataaatctcaacgatattccggtcagaagcggttacacatttttgggatgggctgatacgaagcaggaggcagcggcaggtaatgtaaaatattccagtacagcggctagaactctggaaatgcccaacggcaataagacgatttatgctgtctggaaagctaatagcgacactaggtatcttgtgaattattatgtgcagaaagcaaattcacagataaccgatattagccagttaaaggaagaagattttgagctgtataatgggccggtgacgaagtttggtattacgaattctattgcgaaggatgcagaaaataagcttgcaaaagtaccggccggatatcagtatgcagagggcattgttgatggtgtgacagagggcgaaattgtaccggatggaagccagggctacccgctgacgttgaatctgtactatgtaaaagactttagtgacaagcagacagttcaataccgggttgagtattataaggacaataccatagtattaacagatagctatacccgttctatgcaaatttgggcaggagaagcagcggagatcgcaattcaggaggcgatcgatgcaagagatgataagtatagtggatataggcttgaaggtactgatcctacgaatattccagcaagtggagagcttgtaagtagcggaactgttattagattgtactatgtaaaggacaattttagctataaagtagagtattataaggatagctttgatgcgggtaacagaattgcagaagaagctggcgtggccaaggaatacggaagcagtctgacagatgatctggtagcaatggatctcggagagaactggctgaaccagcaccagcctactggctatggagtgggaagtgcagataacctgccgctgacgatcggagtggaaggaaatgtaatccgtgtgctgtacgagaagaacagctatggctataccgtagagtattatcaggatagccttgatgcgggtaacagaattgcagaagaagctggcgtggccaaggaatacggaagcagtctgacagatgatctggtagcaatggatctcggagagaactggctgaaccagcaccagcctactggctatggagtgggaagtgcagataacctgccgctgacgatcggagtggaaggaaatgtaatccgtgtgctgtacgagaagaacagctatggctatactgtagagtattatcaggacagttttgaggcggataacagaattgcagtagaaagtggcgtggccaaggaatacggaagcagcctgacagatgatctggtagcaatggatctcggagagaactggctgaaccagcaccagcctactggctatggagtgggaagtgcagataacctgccgctgacgatcggagtggaaggaaatgtaatccgtgtgctgtacgaaaagaacagctatggctatactgtagagtattatcaagacagctttacggcggagaattggatcgcaacagaaaacggaaacgagaaggtctatggtagcagtctgacagcagctttagtgtcattagatcttgggtccacctggcggaatttgcaccgaccgaccggttatagtgttggtaagatagagcgtttgccgttaacgatcggagtaagtggaaatgtggtccgcatactgtatgaaaagaacagctatggctatactgtagagtattatcaggacagttttgaggcggataacagaattgcagtagaaagtggcgtggccaaggaatacggaagcagcctgacagatgatctggtagcaatggatctcggagagaactggctgaaccagcaccagcctactggctatggagtgggaagtgcagataacctgccgctgacgatcggaatggaaggaaatgtaatccgtgtgctgtacgagaagaacagctatggctatactgtagagtattatcaggatagccttgatgcgggtaacagaattgcaatagaaagtggcgtggccaaggaatacggaagcagtctgacagatgatctgatagcagtggatctcggagagaactggctgaaccagcaccagcctactggctatggagtgggaagtgcagataacctgccgctgacgatcggaatggaaggaaatgtaatccgtgtgctgtacgagaagaacagctatggctataccgtagagtattatcaggatagccttgatgcgggtaacagaattgcaatagaaagtggcgtggccaaggaatacggaagcagcctgacagatgatctggtagcagcggatctcggagagaactggctgaaccagcaccagcctactggctatggagtgggaagtacagataacctgccgctgacgatcggaatggaaggaaatgtaatccgtgtgctgtacgaaaagaacagctatggctataccgtagagtattataaggatagccttgatgcgggtaacagaattgcagaagaaagtggcgtggccaaggaatacggaagcagtctgacagatgatctggtagcagtggatctcggagagaactggctgaaccagcaccagcccactggctatggagtgggaagtgcagataacctgccgctgacgatcggagtggaaggaaatgtaatccgtgtgctgtacgagaagaacagctatgactatactgtagagtattatcaggacagttttgaggcggataacagaattgcagtagaaagtggcgtggccaaggaatacggaagcagtctgacagacgatctggtagcagtggatctcggagagaactggctgaaccagcaccagcctactggctatggagtgggaagtgcagataacctgccgctgacgatcggagtggaaggaaatgtaatccgtgtgctgtacgagaagaacagctatggctataccgtagagtattatcaggatagccttgatgcgggtaacagaattgcagaagaaagtggcgtggccaaggaatacggaagcagcctgacagatgatctggtagcagcggaccttggagagaactggctgaaccagcaccagcctactggctatggagtgggaagtgcagataacctgccgctgacgatcggagtagaaggaaatgtaatccgtgtgctgtacgagaagaacagctatggctatactgtagagtattataaggatagccttgatgcgggtaacagaattgcagaagaaagtggcgtggccaaggaatacggaagcagcctgacagatgatctggtagcagcggatctcggagagaactggctgaaccagcaccagcctactggctatggagtggggagtgcagataacctgccgctgacgatcggagtggaaggaaatgtaatccgtgtgctgtacgaaaagaacagctatggctatactgtagagtattatcaagacagctttacggcggagaattggatcgcaacagaaaacggaaacgagaaggtctatggtagcagtctgacagcagctttagtgtcattagatcttgggtccacctggcggaatttgcaccgaccgactggttatagtgttggtaagatagagcgtttgccgttaacgatcggagtaagtggaaatgtggtccgcatactgtatgaaaagaacagttacagttataaagtagagtattataaggatagctttgatgcgggtaacagaattgcaatagaaagtggcgtggccaaggaatacggaagcagcctgacagatgatctggtagcagcggatctcggagagaactggctgaaccagcaccagcctactggctatggagtgggaagtacagataacctgccgctgacgatcggaatggaaggaaatgtaatccgtgtgctgtacgaaaagaacagctatggctataccgtagagtattataaggatagccttgatgcgggtaacagaattgcagaagaaagtggcgtggccaaggaatacggaagcagtctgacagatgatctggtagcagtggatctcggagagaactggctgaaccagcaccagcccactggctatggagtgggaagtgcagataacctgccgctgacgatcggagtggaaggaaatgtaatccgtgtgctgtacgagaagaacagctatgactatactgtagagtattatcaggacagttttgaggcggataacagaattgcaatagaaagtggcgtggccaaggaatacggaagcagcctgacagatgatctggtagcagcggatctcggagagaactggctgaaccagcaccagcctactggctatggagtgggaagtacagataacctgccgctgacgatcggaatggaaggaaatgtaatccgtgtgctgtacgaaaagaacagctatggctataccgtagagtattataaggatagccttgatgcgggtaacagaattgcagaagaaagtggcgtggccaaggaatacggaagcagcctgacagatgatctggtagcagcggaccttggagagaactggctgaaccagcaccagcctactggctatggagtgggaagtgcagataacctgcctctgacgatcggagtagaaggaaatgtaatccgtgtgctatacgaaaagaacagctatggctatactgtagagtattatcaagacagccttgatgcgggtaacagaattgcaatagaaagtggcgtggccaaggaatacggaagcagcctgacagatgatctggtagcagtggatctcggagagaactggctgaaccagcaccagcctactggctatggagtgggaagtgcagataacctgccgctgacgatcggagtagaaggaaatgtaatccgtgtgctgtacgaaaagaacagctatggctatactgtagagtattataaggatagccttgatgcgggtaacagaattgcagaagaaagtggcgtggccaaggaatacggaagcagcctgacagatgatctggtagcagtggaccttggagagaactggctgaaccagcaccagcctactggctatggagtgggaagtgcagataacctgccgctgacgatcggagtagaaggaaatgtaatccgtgtgctgtacgagaagaacagctatggctataccgtagagtattataaggatagccttgatgcgggtaacagaattgcagaagaaagtggcgtggccaaggaatacggaagcagcctgacagatgatctggtagcagcggaccttggagagaactggctgaaccagcaccagcctactggctatggagtgggaagtgcagataacctgccgctgacgatcggagtggaaggaaatgtaatccgtgtgctgtacgagaagaacagctatggctataccgtagagtattataaggatagccttgatgcgggtaacagaattgcagaagaaagtggcgtggccaaggaatacggaagcagcctgacagatgatctggtagcaatggatctcggagagaactggctgaaccagcaccagcctactggctatggagtgggaagtgcagataacctgccgctgacgatcggagtggaaggaaatgtaatccgtgtgctgtacgagaagaacagctatggctatatcgtagagtattataaggatagccttgatgcgggtaacagaattgcagaagaaagtggcgtggccaaggaatacggaagcagcctgacagatgatctggtagcagcggaccttggagagaactgggtgaaccagcaccagcctttcggatacggtgtaggaaatgtagataatttgccattgataattggtgtaaacggaaatgtgattcgggtattgtatagtattgatgaaaatcagcgtaaagatttacgatatactgtaaatcatgaagttggggatataatcatcgatacattcttcgttgaatccaatgttcaagtccttcagcctgacaccttaaccagaaaccttgaccacgaagccgaccagaactaccccggctacaccaaggcaaccgtaacctatcccgatggaaaactggttggggatgacgtgacaaagattgataacggagcaacgatcgttgtatcttacaaagagaacgaagatatcaccgtaaattaccagtccgaggacctcaccaaaggcaccgtaaccctcgacaccgagtccatcgcacccgctaccggcgcccccaagggttccgaggcgaaacctgctgacggttatgtattcacccactggaccaattccaatggctataccgtggcaaccggtgaggacaataagcattacacgcctgtgaagaatgctgcaactgaagtattcgaggcagacacctataccgcacacttcactgagcgcggcgacctgagctataaagttgagtattacttcgacggcaagcttggcgagacggtaacgcaggacaatgtgaagttcggtacagacattgcgtatactacgacaaataagacatacaacaaccagaactatgtatttgagaagaccgagggaccgaagaccgttggagcggacagcgagcagaacctgcttaaggtatattacacgctggattccaccggaactgagaagcctggcacacccgatggagtaccggataagttccagatcatcatcagatacgaggctaatgccaacggaagcgtgggtggaacaacggttgaagtgcataccattcaagactttgagcgggatgcagtgaccggcgagatcatcacggttggaccggtaagaccggccaccccgaacgcgaatgtcactatatcggccaacagccgttacacattcgactactggagcatcagaggaaacgctgataagaagtacaacagcaccgatggtctgacgaaggaagcctttattgaagatgtaaccttcgcggcgaacttccgatatgtaggcggaggcaacagtggcggaggaggcggcaacaacggtggtggaggcggcagccccagctacaagcccgataacgacaacggccccggcgcaaccgtcaccatcaaccccgatgacgtccccatggccatcatgccggataccacaccggcagacctgaccgtaatcgacgacggcgaagtgccctttgcggcgctgcccaagaccggacagggatccgtaaagggaacgctgaccatgatgatgtcgggaatccttcttgcgatcgctgcaatgaacaagaagcgcaaggaagaggataactcctgatcggagcagacaaagcattaaaatgtaagcagtaaagacggaggttccggccacttggccggggcctccgccctctatacagtataagagcggctcatgaggtcctataagtaaattcaatgaatagcaggggacgattctgtttgacaagctctgtaaaatttgttagtattagatactaacaacaagcagttaactgaaagtgtgaaatctcccgtttcacacttttaacttattcaaacacgcagaaagagaggatttttccatgggtacaattatcggtgaaggcattacctttgatgatgtgcttctggtgccggcttattcggaagtgattccgaaccaggttgacctgaccacgtatctgaccaagaagattaagctgaacattccgctgatgagcgcgggcatggacacggtgacggaacaccgtatggcgatcgccatggcgcgtcagggcggaatcggtattatccacaagaacatgagcatcgaagagcaggctgaggaagtggaccgcgtaaagagatctgagaacggcgtaatctcggatccgttttatctgtcccctgaacacacattaaaggatgccaacgatctgatgtccaaattccgtatctccggcgtcccgatcaccgagggcaagaagctggtcggtattattaccaaccgcgacttaaagttcgaggaggacttcagccgtcccatcaaagagtgcatgacttccaagaacctggttaccgccagggaaggcgttaccctgaaggaagctaaggccattctgtccaaggccaaagttgagaagctgcctatcgtagacgacgatttcaacttaaagggcctgatcaccattaaagatattgagaagcagatcaagtacccgctgtccgccaaggacgagcagggacgcctgctctgcggcgcagcggtgggtattaccgcaaatgtgctggatcgcgtcgcggctctggttaagtccaaggtcgacgtggtggttctggactccgcccatggccattccgctaacgtaatccgctgcgtgaagatgatcaaggaggcatttccggaggttcaggttattgccggaaatgtggcgaccggcgatgccaccagagctctgatcgaagccggagccgacgctgtgaaggtcggaatcggacctggctccatctgcaccacccgcgtggttgccggcatcggtgttcctcagatcagcgcggttatggactgctactccgtggcgaagcagtacgggattccgatcatcgcggatggcggcatcaagtattccggcgatgtcaccaaggccatcgcggcgggcggcagcgtgtgtatgatgggcagcatctttgcgggctgcgacgagagcccgggtacctttgagttgtatcagggccgtaagtacaaggtgtaccgcggcatgggttccatctccgccatggagaacggaagcaaggaccgctacttccagacggatgccaagaagctggttcccgagggcgtggaaggccgcgtggcctacaagggcatggtggaggacaccgtattccagctgctgggcggcctccgttccggcatgggttactgcggagcgcagaacattcccaccctgcaggagaccggaaagttcatgaagatttccgctgcctccctgaaggagagccatccccatgacattcacatcaccaaagaggctcccaactactctatcgaggaataattacaaacttccgaaagtccgctgcatcccggcggactttcttttagttggccgcaatggcccgcaaacgcagcctgtgggccattatccggccgcaatggcccgcaaacgcagcctgtgggccattatccggccgcaacggcccgcaaacgcagcctgtgggccattatccggctgcaatggcccgcaaacacaaccggcaggcgattgcctggctgaaatggactgcaagcgcagccggtaggcggccgcccggctgcaatgaatcgcaggcagcctccagacgtttgctgacgtagcttgtaccatttgccgcaaggcacagaaaaatgacctctgagggcctcagaacgccctgggagggggagaaaggatgtgcaacatgaaacttaccacactctgctatattgagcgggaaaatgcctacctgatgcttcaccgggtgagcaaggagcaggacgtcaacaaggataaatggatcggcgtgggcgggcattttgaggccggtgagagcccggaggaatgcgtgctgcgggaagtaaaggaggagaccgggctgacgctgctttcctggcagtttcgcggcgtgatcaccttctcgtctgagggctgggaagatgaatatatttgtctgtttacagcggacaaattttccggggagctgacagcctgcgacgagggcgtgctggaatgggtggatcaggaatcggtgctgaagctgaatctctgggagggggataaaatctttttccgccttctcaatgagaaacgtccattcttctcgctgaagctttcctaccgtgaaaaccggctggtgtacgcggctctggacggccgggaactggagctgtttgacgtgcgggacagcgaaggaaatgtcaccggcgtggcccgggaacgtgagctggtacacttaaacggcgatccccacggcacctcccacatctgggtggtgcgggcaaatgcctcgggcggatgggacgtcctgttacagaagcggagcagggacaaggattcctacccgggttgttacgatgtctcgtcggcggggcatctccaggcgagagacgattttctgcccgccgcactccgggagctggaggaggagctggggcttcacgcccgggctgaggacctggaatttgttggttttcacaaggcataccgggaagcggtttttggaggaaggctctttaaagatcatgagatcagcgctgtttacatttaccgcaagccggttgagacctctgcgctcaggcttcagaaggaagagctggaatccgtgatgtggatggatcttgcagactgccgccgcgcagtgggggagaggaggctggacaactgcatgtatcccgatgaattggaaatgctctcccgcaggctgagccaggagaaatgagccaggcatgtacagttccgccgcaattcgccgtaaccgtttaaaaagttgtaaggttattgttagaaaatcggattttcagtctcactttgttgtgatataataaggaaacatatctcttatcatcagcctgacggctggtgacaaagtataataaggaaacatatctcttatcatcagcctggcggctggtgacaaagtataatagtgaaacagtgcaagctgcccatgattccacctgtgcagctcacaatgaaagttccggcggagtctgagaacggaccgcatgccgggagcagccgtaatggaattctgcggtaaaatgatggatcaggagaacacagaatgaaaagacgatttccatataagatactgctgagcgcgtgcctgagcgcggcgttggtcctgggaccggccgcgtatgcctacgcttcctctccggtgatcccaccgttagaggagagctccgtggccagcatgggctcagggggaaactccggcccttccggacagaacggaggaggaccgtcctccggcagcggacaggccgcccagggcagcgcccccggccagggaactaccggaagccagggaaccgcccccggccagggaaccgccggaagccagggaaccgcccccggccaaggaaccactggcagccagggaaccgcccccggccaaggccctgcctccggaaccggcggtccctcagacccgtccgcctcccagagccaatccgccgaccagaacgcaggccagacttccaacactgccgtagcggagccggtgatcgccgcggagggagcagctcttttgaacgcctccacaggcaaactgctgttctcgaagaacggggacacaaagttttacccggccagtatcacaaagctgatgaccgctcttctggttgcggagaactgtaatctggacgataccgtgaccttttcttccaccgccaccacgaatctggaggcgggagccgtgtccctcaatctggtggagggggacaagctgacggtgcgccagtgcctttacgccctgctgttaaagtccgccaacgaggtaggcaacgccctggcggagcacgtggcgggcagcaacgccaagttcgcggatatgatgaacgccagagcggcggctctgggctgcacgaacacgcattttaccaatccccatgggctcaacgacaacgaccattacaccacgcccaacgacatggcgctgatcgccaaggctgcttttgagaacggtacggtgcgcacagttgcctccaccctgtcctatgacctgccggcgaccaagaaaaacgcggccagaaccatttccatcggacacaagatgctgtatcccaatgactcgcgctattacgccggaatcatcggcggcaagaccggatacacctccaaggcgggcaacacgcttgtgacggcggtggagcgggacggcgtgcgcctgatcgcggtggtgatgaagagcaagtccacccactacacggataccaaggcgcttctggattacggcttcgagctggcaaagcagcagggcaccgagggcgcggacgacagcggcccgggtactgggaatcccacagcgggatggaaccaggacgccagcggatggttctatatcaaggaggatggctccagggcgtccaaccaatggctgaagattgcgggggaggactactggtttgatcccaacgcctacatggccgtgggctggcgcaagttcaacaacggcgcgtggtactatttccactccagcggcgctatggcgaagaactgctgggttaagaccaatgaacagtatttctatctgggaagcgacggcgtgatgctgaccgataccgtgacgcccgacgggtaccgggtagatgaaaatggaatatggcggtgatctgccggaagtgacgataaaagcatggagcgttgtggccccatgcttttttgactggatgcaatcattgctgtaaatatgtttcttcgaactggcctgcgcagaccggtttgccaaataggaagccctgggccaggcggacgccgcaggcgtttaaggccgccatctgttcctccgtctcgatgccctcggccaccatgcggatgcccagcttgccgcagatttctgcgatggattccacgattgccctggttctgggattgtgagccacgtcgccgaccatgctcttgtccagcttgagcacgtcgaattccacggaggacaacagggccagattggcgtactcggttccaaagtcgtcgatggcgacggagaagcccgcctcgcggattttgatgatcagcgcccggatatccaggtcctccacctcccgcagactttccgtgatctcgatttccagaagctccggggaaatgccggaggaatcacagattgtggtgagctgctccacaaacatcggctgcgccagggagcagcgggagaagtttacggagaccggaaataccgctttgccctgttccatccagcttttgagcctggagcagacgaacttgaatacgaagaaatcgatctggctgacggctcccgtctcttccatcagcgggaggaaatttccgggcagaaccagggcgtccgggcggggctggtagcggatcagggcctccgttcccacggccgtgcgatccgggcaggaaattttgggctgcagatacacgacaaaacggttttgccgtatttcctcctgcaggacggcgggatccgccaggtgcaacagctcgtcgctgtggtggcggtagcggttggaggccgggtgggtgcggtagaatgtttttttgtcctcgtacatccgggcgtccgcatccgcgataatctggttcagatcgtcgattttttccgaccatcgggaaccgatggccgcgcggtacatgggatccgcgcggaactgggcttttagatcccgggttctgctctcaaaaagttctttttccattccgggacagatgatcacaaattcatctccgccgatccggtagaaattggcgccggggaaggcgcgcttcatcctgcgggcgcactctgccagaacttcgtcgccgtaggcgtggccgcgctggtcgttgatgtcctttaagccgttgacgtccagatagacgattcctacggagacttcggcggaggaaaggtctttcgtgtcctcgatgtaccggttccggttgtaaaaggatgtcagcctgtcgtagtagcttaactgggacagctgtttttggctctgcgcgtgccgccaggccagcatgaggaaatagcacagggtctgcagcagggaggcgatattggacatgtggtccggcaatgggttgtcaacgcctaggtatccggtcagggtcccgtccatttccatgggagcggccaccaggctgtggacggactggctgcgcaggaattcatattccgcagggtcgatatcctttaacgtctccacgtcctcaatcacgatacagccgcgctggtcaaaggaggggagccagcggcggatggcggagaggggaacattgtgccggcgtgccgttgcggcctgcgccccaccggtgctccattggtagatttcgcagagagaatcctcatggatggagacgatgtaagcgcggccggcctgcaggaagcttccaagccgtttgagtacctgggggattgcgctttcaagcacgctttcctggtaaagcgtgcggatgcattccgtgatcattttttccgcatccagcgtgaacctgagctgcaatttctcacactcggactgggtgttgtcgaacgcgatttccatccgggcagtccggccgtcccattcgatcaggcggtcctttaacaggtaatggcagccggtgatgggattggtgtattcccaggtataggtctctccgtcttttaaaaagcggttggtgcagaagctgcagggcgcgtccgcgttttggagcacgcggtagcatttctggccgtccagcgcatccacgccaaaggttttccgcccggcgtcgttgatgaacaacagctcgtaggtttccggatccgccacatacatgagttcggaaatatcgttcatgggagcgcgcagggcttcggacatgcgggagaggtattcgctccggcgctgattggcttcctcggcctgagcaagggctttttggcgtctggactgcctggaggtgtagacggagagcgcgacggccaagagtataaacgcgcaggtcagactgaacaggcttttctgcgccataagcacgcggtcctccgtgtagcgctcggccgcgctcacgacctggtccgccagctcaaagaaacgttcgctggctgcgtacagctggtccggcgagtctccttcgcgaacctggtaaatctgctgccggatctgctgccagtcctctttcatttgcgtcgccagttccaggtatccgggatcgtccaggcgggcgaggccgttttccccttccccggttaaaagctcctcaatgatggcgtcgattttttccatcagcgcgtcgttgggattgttgttgagctcctgcttcaccaggcgctgggtagcgccgcgcactacgccggtatagttgataatgcgggcgttgccttgcaggtgggaaatggagacgagagaaagaaaactggaaatcagcaacgcggccgccaaggtgatgggaatgattttcttttgcataatggctctccccgaacgataaacttctatagttctaattgtcttaatcataacaaattggcggttgatgtcaacctatatttggaaaatagtggtgcggatcatcggtgcaaacgaacgggatatgtgcattatatacaaaaaatgcgtgcgtatacccaggaagattaaacaaaattggtgataagtgcaaaaaaacgctgacattttttcgatggaaatggtaaaataaagaaaaagaacgatacggaggaatgtcacgatgagaagaatcatgagcgcctgcctgttacagaccatgcggtttgataccgcaaacgacgcgaacccggaccaggaatttgagatgttctgtcagaagctggaccggaacaagacccaatatgtgattgaggacaagaaaaaagagccggacggctccctggtggtcaggctgagaaaacagtataatacctacaaaacaaccgggtatatggattagagacaggcatgccggaggcgggagttcaaaccgcctccggcatttctatggaaggcgcacatcctccggcactgcctgcgcgggcggctgccagagcggtgggagacgggcagcggactatttctttttgccgccctttcccttcttgtcgcctttttctttcttggccttgtcgcccttgccggatttcttttccttgggggctttttctttctccgcctttaacggctttccgccgtccttgtcgggcttttcctttccgggcttgtcggccttttttgcggccttttccggtttttccccggcggtcttgcccttggcggcctttttcgccttgggcttgtcggcggcgggttcctccgtctctacgggaagggggccggtccagccggaggtctcgtccgggcagaactccatgatgtcgtcaatgccgcactgcagaatggtacagagcgtatcaatggtgtgggtggacacgtgcatgttcttcttcaggcgaccgatctggccggcgctgaagccgtgctgcttgatcaggcggtattgggtaagctctttgtcttccatggttttccacagacggtcataacgaatcataggctctcctccttgcgatattatccatatttggattgtaacacggaaaaaggcgaaacacaaggaaataaaattggattctatttgggtataatccatatgcttccaggggatagtatggatatgaaacgatgatgattaggaggaaatgaaatatgccagatttgagagacagcgagacagccaagaacctgatgcgcgcgtttgcaggcgagagccaggcgcggaaccgctacaccttcgcggccgcccttgcccggttccagaaaatgccggtggtggagcagatttttacctacacggccaaccaggagaaggagcacgcggagattttctacaagttcctggaacctctggataaggaaaccatattcatagatggaggttatccggtggatatggagcagaacaccctggcgcagttgaacgcggcggcgcacaatgagtttgaggagcacgacgtggtatacaaatccttcggcgacatcgccaaggaggagggcttcaccaggatcggaactgtgttccacatgatcgcggagatcgagaagacccacggggagcggtttcagtacctggcggaccgcttgggaagcggcaagctgcttatttccgatgtaaagaccggctgggtgtgtttaaactgcggtcatatccatttcggcacggaagcgccccagatgtgtccggtctgccagcatgaacagggttattttgtcagtgtggagctggcgccctggtatttgggcagatagcgccggttcggattcgggcgccgcaggcttaaagcgccgcggcgtcctttttactttgaaaattaccgcagttatgctatgatactatctgagactgaaaaagaaagattcggaggaaagacaagagatggcgcacaaggtaaaagcggtgatttttgaccaggatggactgatgtttgacacggaacggctgtcggtggaggcctggaatattgtgggaaaacggttcggcatttccgtgggggacgagttctttgacggaatccggggcagtaagccggacacggtgaagcggctgctgaacgagatgttcgggccggaattcgacacggaccggttcctggaggagaagagggcgttttcctatgatcagatccgcaaatatggcgttccggtgaaaaaggggttgaaggaacttcttacatatttaaaagagaagggaatcaaaacggcggttgccacctccagcggacggcagtggacggagcagaatgtgggaggcgccggtatcgacggcttttttgacgcatacgccttcggggagatggtgacccacgccaagccggacccggagatcttttacctggccgcggatatgctgggcgagaggccggaggagtgcatggtgctggaggacagcttcaacggcataagcgccgcgttaaacggtggtttcctggcggtgatggtgccggacctgagtatcccgggaccggagctgaccgcaaagctcaccgccaaatgcgacagccttctggatgtgatccggctgtttgaagaaggttttttcacggtttaggcggggaaatgcaaactgcggaggtgacgggatgataaaagggataaccactgcggccgcgtttggggcggctgcctgcctggcgcggtcggaatatgagaaaaagcagttctctgtggaggagacctgcatccggtcggacaagattttgaaggacaagacccttgtctttttgtcggaccttcacaacaatgagttcggcccgggaaaccggcggcttttggaggcgatccggcgggtaaatccggacgcggtgctgatcggcggcgacatgatggtgtgcaagggcagacgggatgtggcggtgcctttggagctggtgaaacggctggcgggggatttcccggtgtactacggcaacgggaatcacgagaaccgcatggtctgggagcgggagacttacggcggtctgtacgaggagtaccgggaccggctgaagcggatgggcgtgatctatctggagaacgggacggccccctggggggcggatgcagagatttccgggctggacctgggacagcggtattaccgcaaggctctgtttcagaagctggacccgatgccgccggattatctgacccgcaggctgggacgggtgcggggaaccgggcgggaggagaagtttcagattcttctggcccactctcccatgtattttaaggattacagggcctggggggcggacttgaccctgtccggacatttccacgggggaaccatccgcatcccgggcctgggcggcgtgatgacgccccagtaccagtttttcattccctggtgcgcgggggattttgaggcggacgggaagcgcatgatcgtcagccggggcctgggcacccactccatcaacatccgtctgaacaaccggcctcagctggcggtggtgcggctgaaaaagcagtagcgggcttttcggttctgtggtaagataaatgctgatggccggaagcggaaggaccccgcaaaaacggctgaccacgtgcggtgaaacggcggtttgacgccgtcagggccggaaaaagaggatttatggtacagatatcttacaagctggagcattttgagggacctttggatctgctcctgcatctgattgagaaaaataaggtaaatatttacgatattcccatcgcggaaatcaccaaccaatatctggaatatgtgcggaacatggagcgggaggacttaaatgtcgtcagcgaatttctggtgatggcagccacgctgctggatatcaaggcccgcatgctgctccccaaggaagtggacgaggagggggaggagatcgatccgcgggccgagctggtacagcgcttactggagtacaagacctaccggctgatggcagatgagctggccaggcgggaggacggcgcagaccgccttttgtacaagtcgcccaccattccgccggaggtggccaaatatgagccgccggtggatttggacagcctgttggacggcctcaccctggctaagctgaagcgggtgttcgagcaggtgatgaagcgcaaggaggacaaggtcgacaagatccgcagcaatttcggcaccatccggcgggagccggtgagcctggagcagaagatcggatcggtgcttggctatgccaggaagaaccggcatttcagcttccgccatctgctggaggagcaggcggacaagctggaggtagtggtcacctttctggcggttctggagttgatgaagatcggcaaaatccatctggtgcaggaggagaccttcggggacatggagatcgaagccctggagccggagggggaggaagcggagctggacctggacgggctggcggatttcgcggagtgacgattgaagggataaggacggattgagatggaagagggaaaactgacaagaggcgccggagcggggcagccggagcaggccggcgtacaaaacggccagttggcgctggagtttccgcccaccgagaatgagaaggagcaggaggcggtcgttgaggctgttctgtttaccatggggcgctccgtggaggtgcggcagctggcagcggccatcgggcaggaccgggagacggccagacgggcggtggaacgcctgaaggcccggtatgacaagagcagaagctgcgggatgcagattatcgcgctggaggacagctatcagatgtgcaccaaggcgaaatattacgacaacctgatccgggtggcgtccacgcccaagaagcaggtgctcaccgaggtgatgctggaaacgctgtccatcatcgcctacaagcagccggtgaccaagctggagatcgagaagattcgcggcgtcaagtccgatcacgcggtgaaccggctgatcgagttcaatctggtgtacgaggtgggccgcatggacgcgccgggccgcccggcgctgttcgccaccaccgaggagtttctgcgccgtttcggcgtcggttccaccgacgacctccccagcatgaatcccgagcaggccgaggagatcaaggccgaggtggaggaggagctgcagctgaagctggaggacctggcggttaacggcgacggcggggaagcggctgcggatgcgcaggaagaaacggaggcggatctggctgtggcggaggccgcggcaggggtggagatatcttcccctggaggcgaaaccgctgtccgggccaaaacggccgcccgggatacatcccctgaggatcccacccccgagggttccacccttaaggatcccacgcccaaggaccccacgcccaaggaccccgaccttaccgaggacgagctggcgcttctggagcaggaggccgcctacgcggcggagctggaagccgctgccgcagccagggaggaagaggaggagcgggaacggcgctgaaaaattaggctgagagagacattttccattgctggaagatgtctctttttctggaaattgactcttgacgaaaccggctcgccgtgataggatatcatatgcgttatacatatagtgtattcgtttgacgacaaagcacaatatatagtgatagaggcccggaatgaccgaaaaaccgggcaggacaggaggcaaaagcagtggagtgcagtgaaatcaaggtgattaaaaaggacggaaccagggaggatttcaacgtccagaaggtggtggcggcggtccgcaagtcggcagagcgcgccatgatccgtttttccaaggcggagatcacgtttatctgccagtttgtggaggagaaggcggaggatatggaggtcacggagatccccatcgcccagatgcacaacgtggtggagggcgcgctggagaaggtgaatcctcaggtggccaagagctaccgggattaccgcaactacaagcaggatttcgtgcagatgctggacgacgtttacaagaagagtcagtccatcatgtacatcggcgacaaggagaacagcaacacggacagcgccctggtgtccacgaagcgcagcctgatcttcaacgagctgaacaagtccctgtaccagaagttctttatgaccgttgaggagctgcaggcctgccgcgagggatacatttatatccacgacatgtccgccaggcgcgacaccatgaactgctgcctctttgacgtgaagtccgtgctcaccggcggtttcgagatgggcaacctctggtacaatgagccgaagacattggacgtggcctttgacgtgatcggggatatcgtgctcagcgcggccagccagcagtacggcggcttcaccgtacccagtgtggaggagattctggcgccctatgcggaaaagtcctacgagcagtacattgagaaatacctggacctgggcctgaccgacgagaaggccatggaggtggcgtggagcgacgtgcagcgcgacatggagcagggcttccagggctgggagtacaagttcaactccgtctcctccagccggggggattacccctttatcaccatgacggcgggcacgggtaccagccgcttcgccaagatggctaccatcaccatgctgaacgtgcgtaagggcggcgagggcaaaaagggccataagaagccggtgctgttccccaagatcgtgttcctctacgacgagaagctccacggtccgggcggcgagctggaggacgtgttcgaggcgggaatcgactgttccagcaagaccatgtatccggactggctgtccctgaccggcaaggggtacatttccagcatgtacaaacagtacggtaagatcatttcccccatgggctgccgtgccttcctctccccctggtacgagcggggcggcatgtacccggcggacagcaaggatgtgccggtgtttgtgggccgcttcaacatcggagtggtgagcctgcacctgcccatgatcctggcgaaggcccgccaggagagccgggatttctttgaggtgctggactattacctggagctgatccgcaggatccacatccgcacctacgcctacctgggcgagatgaaggccagcaccaacccgctggcctactgcgagggaggattttacgggggacatctggggcttcacgacaagatcaaaccgctgttaaagaccgccaccgcctccttcgggattaccgcgttcaacgagctgcagcagctctacaacggcaagtccctggtggaggacggagcctttgccctggagaccctggagcacatcaaccggaaggtgaaccagttcaaggaggaggacggcaatctctacgccatctacgccaccccggcggagaatctctgcggcctgcaggtgaagcagttccgcaacaagtacgggatcattgagaatgtttcggaccgggagtacgtgagcaacgggttccactgccatgtgaccgaggagatcacgcccattcagaagcaggacctggagtaccggttctgggagctgtgcaacggcggcaagatccagtacgtgaaatatccggtgggctacaataaggaggccatccgcaccctggtgcgccgggccatggccatgggcttttacgagggcgtaaacctcgccctgtcctactgcgacgactgcggccaccaggagctgaatatggacgtgtgccccaaatgcggcagcaaaaacctgacgaaaatcgaccggatgaacgggtatctgagctattcccgggtgaagggcgacacgcggttaaacgaggccaaaatggcggagatcgcagagcggaagagcatgtagggcgatgggaatattttccctgcccgggctttgggggttgcttttccacagaaagtctgttaggataaaagaggaataaaattcataaaaaaggaagtgaacactcagtggaaggtcgaagttgcaagatgaaagcggacgaatctggatatgtgcataggcgtatggatcaggcggtagtctgctggagcaggttcggcggctgctgattggtgatgccgtgaaactgcccgcggcggcaggacggcgtttgatagaggagaaagatccggcgtttatggagaggcggctgtttccccggtctggggtgcggcagtctctccttttgcgtgtgtgcaaatccatggtttgctttcatcggccaagacagaaattgtgccgagaggagaacgacatggagaaaatgattgaaatgatgttaaagctggcggaggaaaaacagtaccgccggttaaaggagctactggctgagatgaacgaggtggatatcgccgccttcatcgacgagctggattcggagaaagccgtggtggtgttccggattctgcccaaggaactggcggcggatgtatttgcctgcctgtccgtggagaaacagcagcatatcatcaccagcatcacggaccgcgaggtggccaccattatcgaggacctgttcgtggacgacgcggtggatatgctggaggagctgcccgccacagtggtgaaaaaggttctgcagaacgccaagccggacaccagagccctgatcaaccagtttttaaaatacccggataacagcgcgggcagcatcatgaccgcggagtacgtggggttaaaaaagaccatgaccgtgaaggaggccttcgactatatccgccgccacggcgtggacaaggagaccatttacacctcctatgtgatgaacgaggccaggcagctggagggcgtggtcacggtgcgcgatctgctgatgaacacgtacgagaccgtgatcggcgacattatggacacccacgtgatcaaggcggtgaccacggacgaccaggaggaggtggcggactgcttccagaagtacggccttttaaaccttcccgtggtggaccacgagaaccgcctggtgggcatcgtgaccgtggacgacatcgtggacgtaatcgagcaggaggccacggaggacttcgagaagatggccgccatggcgcccagcgagcggccgtatctgaaaaccggcgtgttccagctggccaagaaccgcattttctggcttctggtgctgatgatcagcagcctgatcacgggcgggattctggccaagtacgagaacgccttcgcggtgctgccgttgctcgtgaccttcatccccatgctgacggataccggcggaaacgcgggcagccagagcagcaccctgatcatccgcggcatggcggtgggcgagatcgagcccgcggacgtgttcaaggtggtgtggaaggagctgcgcgtgggcactttggtgggagccgtgctggcggcggtgaattttgtgcagcttttgatccgcttccccggccagcctctggtctgcgccaccgtggtggtcagtctgatggccaccgtgattctggcgaaaaccatcggctgtatgctgccgatggcggccaaggttctgcacatggacccggccatcatggcggccccgctcatcaccactatcgtggacgccttaagcctggtgatctattttcagctggcctgcgcgctgctgggactgtaagggcgggattggacaaaaggagagcggcgacggaatatggttaaccgtcagccgctctttttgtatggagccaatgctcctcgcccgcgtttgcgggcagttgtgcccggctcttcctcacgggactcagacgtcatgcctgccgtccgccagtcccttaatgtaggccatggccttgtctttgctgcgcgagtccaggacattataatgatccagaagcgtcttctggttttccgtcagcacggtggagattccatccctcttataaaattcggccatggtaattcccatggccgcacagacacgtcgcagagtgacaatactgggcgtagtcgttcggcgaaagaggttgcttatgttatttgcggaatcattcatttcttttgccagcttgtagtggctccacccgcgctctctgcacagttcttcaatccgatccagttcataactcattcttccaccaccaagacaaaattcacgataccccgtggttattgtaccccaggaaccgtttaattatcagactgaaaaagcgtgtacaaatagacactttatagtgtataatctagggtaatcaaatagtaggaggggagattaatgagcggatatatcatcgaaactgagcatttcgttgggtgtcacattgaaaaaatggcagagggcccgtagctcgatgtctgtgacaaggcgagtgcccttttcgattctgagtatggtcagatcattgaaatcatagccgtttaattgcagcttggcggccagcgcccgctgggaaaggccgcgccgcttccgcaatgagcggatcgtatcgcctatcaaatttttctttgtttccgaattataagatattttcattatttacctcacatgatatggaattttctaatactgaagcgtttattagattgtaaggaaatattaattgccaaacacttctaatagtgaaacacatcaaaataaaatatgcatgaatgaaagggagaagagatgaacaagatattggaacaactggagcaagaggagattatggattacaaaaaagaactgaagcagtatctggacgagattccggatcagtatttctatgaatttttccatatccgctctatgacggatccggtctacgacgggatcagccaggatttgatgtccaggggatactatgcgctgctggccagattctcggaatttcacaaggatctgaggcgctttctacatgaatataactgaattttgtggaaaaatcatcttccgtatggtaaactaagaaaagtggccttcgggccctaccaatgaatacggagggatatacaatgaaaaagtttctggatgagtttaaggcgttcgctctcaagggcaatatgatcgacctggcggtcggcatgattatcggcagcgcgtttacttccattgtaaattcgcttgtcaacgacatttttatgccccttctgagtctgatcaccggcaaggtggatttcaccaacatgtttatcgcgttggatgggaatacatacgccacgctggctgaggccaaggaactttctgtggctaccattaattacgggtctttcatcacacagacgatcaacttcctgctgatggctttggtcgtgttcatcacagtgaaacaggtcaacaagctgcgcagcatgggaaagaagccggaagcgccggccgctcccacgcagaaggaatgcccgtactgccgcactatgattccgatcaatgcggtgcgctgccctcattgtacctctctgctggaaacatctgaggaaacggagagagagtaagtcatgcgttatcacaatattacaaaggacgatatgctcaacggggaggggctgcgggtggtactttgggttgccggctgcagccacaactgtccggaatgtcacaatccggtgacctgggatatccggggcggaattccctttgaccaggcggctaaggacgagctgtttgaggagcttcaaaaggactatgtgtccggggtcaccttaagcggcggggacccgctgcacccggataaccgggaggagaccggccggctgatcgatgagatctgcgaccgctttccgggaaagaccatctggctttacaccggctacgactgggaggaaatctgcggcctgccgtgtatccgcaaggtggacgtggtggtggacggcgagttcgtggcggggctcaaggacagcagcctccggtggaagggcagttccaaccagcgggttatcgatgtgcagcggtcccttctgaccggcgcggcggtgatccacgaccggagctgagacagccgccatggagcggacgattcgaatcatacagaaaaggttaggttacagacatgcagagaattgcaaaatttcacaaggtaagctttgaacaattttccggggactggacggacgccttcggcggagtgtctgccgatgaggcgcgggcggtctatgacgggatccgccttccggcccgggccaccgccggttcggcgggatacgacttttttaccccggtcgctgtgaccgtcgcgcccggcgagtccgtgaaaatccccaccggagtccgggttgagatggaggagggctgggtgctgtccattttcccgcgcagcagcctgggctttaaataccgcctccagctgaacaacaccgtgggtatcatcgacagcgattatttttattcggacaatgaaggacatatgtttgtcaagatgaccaatgattccagagagggaaaaacggtggagctggccgcaggaatggcctttgcccagggtattttccttccctatggtatcacggtggacgatgattgcacaagcacgcgcaacggcggcttcggcagcacggatgcgaggtaggaaatgagcagaaacagtggaaatatccgctacagcgagcggcgtccctacgattcggggcggaatccgcgcctggaccgggagcggcgggccgcgcgcaagcgcaggagaaggaaccggctggtcaaagggctcatcgcgtgggcggtctgcatactgctggtggtgctggtggccttcgccaccatgcgcgtggtgggtaacatgtccacgtccaagcagcgtgagctgcgggccgcgggaattgaaaagctggacgccggggactttgccggggcgattgcggattttgaccaggcgctggctgtgatggacaaggacaccggcgagatggcggtggacgtgctgcgctaccgggctgaggcggagtaccgcctggaggattacgaggcggcgtactacagctacaagcttctgatggagcgggactccaaaaatctgcagtattggtacatggccagcatgtgctgcgcggccatgggcgatgcagaccaggcagtggagctgtacgactatgtacagcggaccggcggggatgcaaagaagccggtggaggggcgtctgaatgcgcttctgtccgtgggggcggcctgcgtgaaaaagggcgcctacgatcaggccatgagcctgtatgaaaatgcgctgagggatgggctggacgatgggaaaatctatttgcagatgggtttatgccagatggctgaagagaattacaaggacgctgctgattcatttgaccaggggaaagtgaaggcatcagaggatcgggagctgcttcgggaactttcgtataaccgggcggtgtgcagcgaatacttatacaagtacgacgaagccctgaagctgttcgaggagtacaacaagagcttcggaccggatgagcgggcggagcatgagattgcatttttaaagagccggtaaggcgtttggcggccggagcggtaaattcggaataagaggtagtatggcagaattatttgatttgaaagagactgaggagcgggtggtcctgatcgcggtgagcaccggggacggggacgacgcggagggctccttaaaggagctggcggagctggtgaaaacggccggagccgtgaccgtggacaaggtgattcagaaccgcgagaaggtgcacccgggcacgtatctgggcaagggcaagatcgaggaggtcaaggacctggtatgggagcttgacgccaccggcgtggtctgcgacgacgagctgagtcccgcccagcttaagaatctggaggcggccctggacaccaaggtgatggaccgcaccatggtgattcttgatattttcgcttccagggcccatacccgggagggaaagatccaggtggagctggcccagctcaaataccgggccgcgcgcctggtgggcatgcgcgcctccctgtcccgactgggtggcggcatcggcaccaggggaccgggcgagaagaagctggaggtggaccggcgtctgatccacgagcgcatcgggcagttgaaagcggagctggaggatgtgaaacgccaccgcgaggtgacccggcagcagcgggaacagggctgcgccgtcagcgcggccatcgtgggctacaccaacgcgggcaaatccaccctgttaaaccatctgaccgacgcggatatcctggcggaggacaagctgtttgctaccctggaccccaccaccagaagctttaccctgccgggggaccagcagattctgttgacggacaccgtgggatttatccgcaagctgccccaccacctgatcgaggcatttaagagcaccctggaggaggccaagtacagcgatatcatcctccatgtggtggattgctccaacccgcagatggacatgcagatgcacgtggtgcgggagacgttgaaggacttggagatcgtggacaagacggtggtcacggtgttcaacaagacggaccgcctgagagccatggtggagtccggtgaggccgggccgttagcccagttgcccagagatttctccgcagactaccaggtgcgcatctcagctaagaccggggaggggctggacgagctgtgcggcattctggagcagatcatccgcagccgccgggttcacctggagaaggtctacccctactcccaggccggccggatccagaccatccgcaagtacggccagctcctgaaggaggagtacacggaggacgggatcgcggtggaggcgtatgtgccggcggaactgtttgccaaattgtatgcggattagagggtagaaccccctaaccacccgcaaaccacgcagccacaaggctttccgcgaattataagcagaggtaataaaacacaatatcttgattggcataaaaagttgatcatagatattgtgtttttgttttgggtctgctataatgggtgaagtggcggactgacagagagacggaaacaccgattgtcgtcaacggatcatgggtccggggattttcggagcaaatggaatgggctgccggcgtagccggcgggccattatgtcttatgggataaaagccgggggccattatcatcggacaagggtcgaaaggagttatgtttgtaatgattgaagttgtgaaacgtgatggggagatagccgaattcagcctgaacaagatcaccgaggcgatcaagaaggcgtttaaggccacgaagaaggattataacaacgagattctggagttgctttcactgcgcgtaaccgcggacttccagggcaagatgacggaaggccggatttccgtggaggagatccaggacagtgtggagcacgtgctggagcagaccggttacacggatgtggcgaaggcatacattttatatagaaaacagcgcgagaaaatccgcaacatgaacagcaccattctggattacaaggacgtggtgaacagctatgtgaaggttgaggactggcgcgtgaaggagaattccaccgtgacttactccgttggcggactgatcctgagcaattccggcgctgtgacggccaactactggctcagcgagatttacgaccacgaggttgcggaggctcaccggaacgcggacatccacattcacgatctgtccatgctcaccggctactgcgcaggctggtcattaaagcagcttctgcaggagggactgggcggaatcaccggaaagatcacctcttccccggccaagcatctgtccgtgctgtgcaatcagatggtcaacttcctcggcattatgcagaacgagtgggccggagcccaggcgttctcctcctttgatacataccttgccccctttgtgaaggtggacaacttgagctactctgaggtcaagaagtgcatcgagtcctttatctacggcgtgaacacccccagccgctggggcacccaggcaccgttctccaacatcaccctggactggacggttcccaacgatctggcggagctgaacgccatcgtgggcggcaaggagatggacttcaagtacaaggactgcaaagcggagatggatctgatcaacaaggccttcatcgagaccatgatcgagggcgacgccaacgggcgcggcttccagtaccccatccccacctactccattaccaacgatttcgactggtccgacacggagaacaaccgcctgctgttcgagatgacggccaaatacggcaccccgtatttctccaactatatcaacagcgatatgcagcccagcgacgtgcgcagcatgtgctgccgcctgcgtctggacctgcgggagctgcgcaagaaaaccggcggcttcttcggttccggcgagagtaccggctccgtgggcgttgtgaccatcaatatgccccgcatcgcttacctgtccaaggataagaaggatttctacgagcgcctggaccacatgatggacgtgtccgcccgctctttaaagaccaagcgtgaagtgattaccaagctgctggatcagggcctgtacccctacaccaaacggtatctgggaacattttccaatcacttctccaccatcggtctgatcggcatgaacgaggccggactgaacgccaggtgggtgcgcaaggatatgaccgatccggagtgccagaagttcaccagggatgttttaaatcacatgcgtgagcgcctgtccgactaccaggagatgtacggcgacctgtacaacctggaggcgaccccggccgagtccaccacctatcgcctggccaagcacgacaagaagcgctatcccgacatcataaccgccggggccgagggggatacgccctactataccaacagttcccatctgccggtggactacaccgaggatgtgttcgacgccctggacatccaggacgagttgcagaccctgtacacctccggcacggtgttccacgcgttcctgggcgagaagctgcccgactggaaggcggccgccaacctggtgcggaccatcgcggagaactacaagctgccctattacaccatgtcgcccacttactccatctgtaagtcccacggatatctggccggcgagcacttcatctgtccggtttgcggcgcaaaggcggaggtttacagccggattacgggatattaccgtccggtgcagaactggaatgagggaaagacccaggagtacaagaaccgcaccaactacgacatccacggttccaagctgaagcacggcgtctcccacatcaagccggagagccgctgcaatgcggaggagcagaaggctgctgcgtccaagggtgaggtgaaggcggataccggcctgttcctgttcaccaccaagacctgccccaactgcaaggctgccagggagttcttgaagggcatgaactaccgcgtgatcgacgccgaggagcatccggagctggcggagaagttcaacattttccaggcccccacgctggtagtggattttgagaacgacggcatcgtacagaagtttgccggagcttccaatatcaggaaatttgtggagcagaacaaggagatccttcgggtttccgtttgataaacgatcaatttaatattgggaaatgaacggccggcgcagctggagacagctctgcgccggctttttgtccgcccgggggccgggggtggagcgggattcgcggcttgtggtctgaagtaggatgtggtataataaggaaacgtatctcttatcgtcaacctgcggttggcgacaaagtatcatgcattgaatcgtgggacggacgtgcgaaggaggatttatggatctgattttttggtttatggggggtctgtgcattgcggagggcatcgatttgttcatgggcaaggattttatgatttttgtggggacaaacgttgataaaagcgactatgatgtggataaagtgtacgcggtggagaaatggctgttcctggccgacgcgctgctgagttttgccatggcttcccatatcttgtccgagccgttggaatgggtctgcatggtggtatttggtttgacgctggtggcccatgtgtatgtgtttaagagcaagcggttccggaaggagccggggagcgggaaaaagaagaaatgatcaggagagggctgctgggcagtgcacgctgcgggaggagcgccggtaatcggacggcgtttgaccggaaaagggcattggcagcagcctttgcatgaatatgagaaacgcagtgtcaagaaacgccgcggtttaaaaaaccgcagttactggatcttcgccttatccagagcggtctggatggcttttaacagcgcggccgaggtgtaacgggactggctggagtatgtaaggttttccagggactgggtgctcacgatctgatccgccagctcgtcgagcgtgggctgcatcagcgggtacatggtggtgactgcttcgcttaagggcaccagggacacggagctgatccggttggcatccacggccacctgcacgtttacgtcctggtttcccagattcagggaggcgctgtagacgccggggatatagctggccgcttcgctgccggctgtatcttttttgggacggaacataatgaggcacagggtgacgagcagaatggccaggcccacgaagatcccggtgtagataatctctttcatgcgcagcacgacgattttggttttggagctcatagataaaacctccggtacaatttgttatagcttatgagcggatgggaagaaatatgagcggcatcgcagcaatacattcgattggaagcgacaggaggaaaaaacgtggcgttacaatttgttttcggcggttccggttccggaaaaacccgctatctgtatgagcaggccatccgtctgtccctggaacagccggaccggcgttttctggtggtggtgccggagcagtttaccatgcaggcccagaaggagatcatccgcctgcacccaaggcgcggcatcatgaacatcgacgtcctgagcttcaagcgcctggcctaccgggtgttcgacgagctggcggtgaaaatgccggtggtgctggacgacatgggaaaatccatggtcctgcgccgggtttccggccggaaaaagagcggtcttggcctctacggcagccatctggggcaggctggtttcatcaatcagctgaaatctcagatttccgagctctgtcagtacggaattacgcctcaggatctggagctgctgcagggggagacggagaacccgctgttgaagcagaagctgggggatctggggctgatctttcaggaattcaaggattatattgcggatcactatatcacggcggaggagattctggatattttgtgccgggaattgccgcgctctgagatgttgaaaaacagcgtgattttcctggacgggtacacgggctttacgccggtgcagtaccggattgtagagctgtttatcacccacgccctggacgtggtctgcgcagtgacggtggattacggggcggacccctaccaggagagcgggattcagaacctgttttacatgagtaagcacacggtctgccgcctggcggccatggcgaaggccggaggggtggagcttaaggaggacgtgattttggaccggcggcctgcctggcgttttgcccagagcccggccctggacttcctggagcagaacctgtaccggtacaacgggagggtctggaagggagagcaggatcaggtgaagctcttctgcggtcagacgccggaggaggaagtgcgctatgtgaagagccgcatcgagagtctggtgcgtgagcaggggctgcgctaccgggacatggcggtggtgaccggcgacctggcggcctacggccgggagatcacccgccagtttgaccaggcgggaattccgttttttatggacgacaagaagagcatcctggaaaaccccatggtggagctgatccgcgcggtgctggaggcggtgcgggacttctcgtatgagaatgtgttccggtatttgaagactgggttggtgtatgacagggcggaaggaacggcggataaagcccagcccgtttgggaaaacgcggtgggagcggattccggcggggaagccattgactgggaggaagccagcaacggcgagctggcggacgttctgctggggggaaccgggggaggcgcagaccggcgttacagccgggaggaagccgcggttatgacggaccggctggaaaactatgtccgggcgctgggaattaacggctggaagcgctgggacagccagtgggaggcgcagtttaagggcgcggaaaatttaaatctgcaggagctgaacgcattccgccaatggattcttgcgcccctgcgccccttgcgggaggccatttcaaaggacgccacggtggcttccgtgacccaggccctgcggaactatctggaatccatggagcttagggaaaaactggaggagtaccaggcgtattttgccgcccggggcctccggggggatgagaatctggcccgggagtacggccaggtgtatgacagggtggaggaactctttgagcgcctcaccggtcttttgggcgacgagaaggcggagcgcaagagttatgcccagattttggatgccggctttggggagatccaggtgggcgtgattccggccaccatcgaccaggtgatggtgggcgatatcacccgcacccgtttggacggcgtgcaggtgttgttcttcgtgggcgtcaacgacggcgtggtcccccagcgcaagaacggcggcagtctgttgggcgaccgggaccgggaatttttcaaagcgcatcgcctggagctggctcccacggcccgggaggacggctgtatgcagaaattttacctgtatctcatgctctccaagccctcccggcgtctggtgatcacctacgcggggcgcagcgcggacggtaagagcctgaggccatccgtgcttttgggggaggtttacaagctgtttcccggcctgacggcggaggacggctccactgtgaaatggccggtgcagacgcccagggacggcaaggagacgctgattcagggattaaagacctaccgggatttaaaggagccggatgctgcggacggcgcgttggaggattcgcagtgggagcggaaatttttggagctgtaccggtggttcttcgggcgggaggattaccgggaaggggtgaaactgttggtgcaggcggcattttactcctatgaggagcgcggaatcggccgggcggcggcgcgggcgttatatgggaaaattttacagggcagtgttacccggctggagcagtacgcctcctgcgcttacgcccatttcctgcggtacgggctggagctgatggagcgccgggagtacgagctggaggcggtggacatgggaaacctgttccatcagtccattgaccggtgtttccaggtgatgaaagcccagggacgggactggcgcaacctgaccgaggagggacgccaggggttggtgaaagagagcgtgtcccaggtggtggcggattacggcaacaccatcatgatgagtaccgcccgatacgcttacctggccgggcgggtggagcggatgacggaccgcaccatctgggcgctggccgagcaggtgaagcggggagattttgagccagcgggatttgaggtgtccttctcagcggtggacaatttaaaggccatgcgcatcgccctgtcgccagatgaggagttgcagctcagaggccgcatcgaccggatggatctctgtgaggacggcggaacgctctatgtgaagatcatcgactacaagtccggcggcaccagctttgatctggcggccctgtactacgggctgcagcttcagctggtggtgtacctggatgcggctctggagatggaggagcggaagaatccgggcaaggaggtggtgcccgcgggcatcttctactacaacatccaggatcccctggtggagaagaaggaagccatgacgccggaggagattgaacagcagattctgcgccagctgcgcatgaacggcctggtcaaccgggagctggaggtgatccgccacctggaccgggaaattgagacccagtccgatgtgatcccggtggccctgaaagccgggctgatccaggagagccggtcctccgttgccagcggaaaacgttttgaacagttaaagtcttatgtaaaccggaagctgcgcacggcgggcagggatattctggagggcgacacctccttaaagccctacaagcagagcgcccgcaccgcctgcgactactgtccctaccacgcggtctgcggttttgacaccaagaccgcgggatacggctatcggaagctgaaggcgttgaagccggaggagatctgggaggaattggggacggaagaccgggcggagaccgatggggagtagcgcgtggggcggccggattttccgaagagcggtattccgcagattcagacagaaaggaacctagataaatggcagtgaaatggactgagaaacagcagcaggtgatcgacagccgcaaccggaatctgctggtatccgcggcggcgggctccggcaagacggcggtgctggtggagcggatcatccgcatgatcagcgagggcgagcacccccttaacatcgaccagctgctggtgatgacctttaccaacgcggcggcggcggagatgcgggagcgggtcggcgcggcggtggacaagttgttgaccgtctgcccggacgacgagcatctgtggctgcagggggcgctgattccccaagcgcagatcaccaccattgacagtttttgtctgaatctgatccgcaaccattacagcagcctggagatcgatccggctttccgcatcggcgacgagggggagctggctctgatgcgggtggacgtgatgaaggagatgctggagcggcattatcaggagggcggcgaggatttcgcggcctttgtggagcagtttggccgcggcaagtccgacgccgggatcgaggatgtgattctgcaggcctggcagttctcccagagccacccatggcccatggagtgggtggccgcctgccgggaggagctgcgggaggagactttggagcagatcgagcagagcccctggatgcagtttatccttcgggatgtgcagctgcagatggaggagctggaaatccagctgggggaagccatcgacatgtgcggggaggagaacggccctctggcttacgagcccatgctagtgaacgacaggcggcagattcgggcggtgcgggaggccgccgggaaggggacctaccggggactgtacgaagaattggggaatatttcctttggccgtctggctgcgatccgcagcaaggaggtggaccaggagaagaaggcctatgtatccgcctgccgggaccgggccaagaaggcggttgccaaatgccaggagaactacggcgtacagagcccggaggagatggtggaggcggtaaggggaaccgccggggtcatttccacactgctggacctgactgaggatttcgaccgctgctaccgggagaagaagcgggaccggaacgtgctggatttcaatgatctggagcatttggcgctggaagtgctgatggagccggtgccggaggaaggcggcgccggggaaccgggcgcggtggcggaaccggctgccgcgccctcccggcacgtgcctttccggccggttaagcgccgccccaccgcggtggcggacgagctggcgcgccagttcgaggagattctggtggacgagtaccaggacagcaacaacgtgcaggaaacgctgattaccagcatttcccgggagcgctgggggaaacccaatgtgtttatggtgggggatgtgaagcagagcatttaccggttccgtctggcgcgtccggagctgtttatggacaagtacgagcggtattccgtctccgagagcctgcaccagaaaatcgagctgcaccagaacttccgcagccgggccacggtgctcgacagcgtgaacgatgtattttacaagatcatgaccagggcgctggggggaatccgctatacggaggagacggccctgcacccaggggcacagttcgcgccgggcgagcggaccggcacgcccacggagctgcttttggtggataccggggcggacgccttgaagcagctggacgaggaggcgatggactacacggccaaggagctggaggcccgcatggtcgccatccgcatccgggagctgatggacccggaaaacggcctgatggtctgggataagggcgcggaggaataccggccggtccgccttggggatatggtgatcctgctgcggagcttaagcggctggtccgaggtctttgtcaacgtgctgatgaacgaggggattcccgcttatgcgcagacgaaaaccgggtatttcaacaccgtggaggtggagacggtcctaagccttctggccgtggtggacaatccgatgcaggacattcctctggccgcggtgatgaaatctcccatggtttccatgacggacgaggagatggcctggatgatggcggcctacaagcgcgcgcccgaaaagggccaggaccggggtgtgtacggtgcctttatgcactggaaggaaaatggcggggaaggcgtgaacgcgcctgaggaggccgtggaggccattggggagaagctggcatgcctggaaacgcttctggagggcctgcgccgggacgcccgctatctgccggtccaccagcttttgtaccgggcctttgaggctggcggttactacgattacgtgtccgccatgccggcaggggagaccagaagggccaacctggacatgctggtggagaaagccatcgcctacgaggctaccagctacaagggcctgttccattttatccgctacatcgagaagctcaaaaaatacgacacggacttcggagaggcaaatgtcgccggcgagcaggcggacacggtgcggatcatgagcatccacaagagcaagggtctggaattcccggtggtgtttctggccggaatgggcaagcgtttcaataaacaggacgcctacggggccgtgctgctggacgcggaccttgggctggcagcggattatctggacttaaaacagcgcctgaaaatgccgacgctgaaaaagcaggctctgaagcggcgcatggagctggaatccatgggcgaggagctgcgcgtgctctacgtggccatgacccgggccaaggaaaagctgatcatgacggccacggaccgttccctggggtcaaagatggaaaaatgggcccaggtgccgctggcggacggggcgatcccctacaccattttgtcggccgccggttcgttcctggactggctgctgatgagcgcctgcgacggcacgatccggaagcgccagatccccctgaccggactggtgggcatggaaatccgtcgccaggcttcgcgccaggtctcccgggaggagctgctgaccctggacacggatacggtctatgacccggaggcggcgaggcagttggcggatgcgctgaactaccagtatccctacgggggagacaccggcctctacgccatgctgtccgtgtcggagctgaaaaagcagggacaggtggggcaggacgaggaggagatcggcagaggaaggattttgggaggcggagaggaagcgcgcattttgggagatgtttggactgacggcgtgggagaggttggcccggaacgggccggagccgtcggcaggagagaggctggtctggaacgagctggaaccgtcggcgggagaaaggtcggcatggaacgggccggagccgtcggcgcggcccgcggaacggcctaccaccgggcgctggagtgcctggatttggggaagctgcacagccgggaggacgtcggcgcggccttgaagtcccttctggaaaccggatacctggagcgggaagcctatgacgcgctggatgaaatggtcatttttaccatgttgaacagtccgctggggcagcgcatggccgaggcgcagcgggacggaaggcttcaccgggagcagcagttcatcatcggaatcccggcccgggagatgggccgcggcgattcccaggagctggtgctggttcagggtgtgatcgacgcctacctggaggaagaggacggcctggtgctgatcgattacaagacggaccgggtgcccggagggcgcgccgggcgggaatgtttggcggagcgctaccggcagcaggtggcctattatcagagggctttggagcagctgacgggaaaaaaagtcaaagagaacataatttactcattgacattacaggaaagtgtcttattatagtatgtaatatcattttaaaacagaaagggcgagggctatggaaaagagactgagagggcttttggatcaggcggcttcacagcacagcagaaaccagggcaggcagattgtcaggagatggcaggccaaggcgtggacgctgttgattctgtgtatcctggcctgtttgctgtcgatctattatctttggaggccgtggcgttttctggcgatggcggggttcgcggcggtatttgtttttggtatgtacctgctggtccgcggctacaaccggttgatcgtcagcctggtctgcgatcagtgcgatcccagcctggcgctgggggtgatgcgcgaggcggaccgcggcccccttttggggctgtttgtcaaccgcaacgtggagaccgttgccgcggtgctcaactgcatgatgctggaaggccgtgaggacgaggcccgccaggccatgaaggagctggagctccactcccgggcctgggattaccgcagaaccgtgctgctgtgcgactatcattttatgaaaaaggacagcatggagatcgataaggagtacggagcccttgggaaatttgccgccgcaggctaccgcgacgccagacagaatttcaagtggatgcacgatatgcagcggatgaccgagctggaggatttctacgactacacccgggaaccggagaaaaagcagaaataccgcgaagagttgaccgccctgctggaggaaaagatccgcatgagccacaataaggcccagcggctgcagatgatgttccgcctggctcagattgagtttaaggaggaagagtacgaccgcgcggccagacttttggaggagatcgccagggaggggaataccttgggcgtggccgggcaggcccagcagatgctttcgcggctgtaccggtgacggatggaagatgagcgccgtttgtctgtgaagagaatgaaaaaaggtaaaaaatgggagttcatatcgccgggaaggggatgtgggctcctttttttaacctatttttattccattttggcgtattttctgagctgaaccacgatgtcgcggacgccatctagcagtacattctctaaaatcgtgtgcatatagcatctgctattcacgccagatgcacgcctgcgaagctagtcgtagcgcccactacgccgtcgcttcgcagacgcacatctgacgcggatatcaggcactctttgcacacgagtttagagaacgcacgactggaatgcggatcactgtaacaacggagcttccgcctgtgctgagatttcgacttcaaaaatcatacatggtagttcgcgcggcgtgcagctttacctcgaaggaaagccctctttgaagaatgatttgtttataaaacagatggatcgcgttggaagccggaataatttccccacgaacacattgcatttttacacccccgaatgtataatgaaaaccggtacctgacagtttaccagagtaaaggagtacacatgattcaattagagagaaccagcgtgatgaacctggagaacgcaatcaggggcgcgcgcaatcccatgaacagctgggggaggatggacagcggctacgacgaggacggtcagttcgtgctgggtcccaacgacctggatctggcccggagactgcgcaaggccggaagcgatcaccgcaagttcctgcgccaggtgttcgtctccgtggacgtcaccgccccgctgtactggtggaaggagtacgacacctataaggttgccaccgtggccaactccaccagcaccatgcataaaatacacagcaaacccttcgagctcagcgatttcagctgcgaccatatgacggagggaaccctggcgtttttcgagaccgtgatcgaaaagctggaggagatccggctgcgctacgtgaacgagggtaaaaacaaggaggactggtacgacttaatccagctgctcccctccagctacaaccagatgcgcacctgcaccttcaactatgagacgctgatcaacatatatttcgcaaggagaaaccataagcttctggagtggcacaccttctgcgactggattctgacccttccctacggcagggagctgatcgcagcagaggaggaagaggcaggaagcgaattgcagtgaaggaggataaggcatgaacctgatcgttgcggttgatcaaaactgggctatcggaaaggacggccgcctgctggtgaacatccctgcggaccggcagctgttcatgaaggagaccaccggcaaaaccgtggtcatgggccgcaagactctggagagccttccgggcggccagccccttggaaagcgggaaaacatcgtgctgacccgggacgaaaactaccgggtgaagggcgctgcggtctgccacagcgtggaggaggccctcaggcttttggagggaaaggacccggaggacattttcatcatcggcggacagagcatttacgagcagttcttaccctattgccataccgcccacgtgacctttgtggactatgtctacgacgcggataccctgttccccaacctggagcagaacccggactggcggctggcggaggagagcgatgaacagacgtattttgacctctgctattattttcgccggtatgagcggatcagataaacaaaaaaattgtaaaatacaataaatatctaaaagattttttgatttgtttggaaaaactattgtaagtctgaaatgaaaatggtaatataaaatcaatgcgaaagcagaatgggggatttgtgaatgaaacaagacggacagagatttaccctggaaaatgaggaactgctggtagcggtgaaccgtcacggagcggagctggcccggatctacgacaagttggcggggcgggagcttctctggaacgcggacccggctgtctggaaccggcacgcgccgattctgttcccctttgtgggaaaatgctacgacggcaagtaccgccaccaggagaaggaataccccatgggcgcccacggctttgccagagacatggagttcgagccgctgctctgcgacatggacgagtgctggtaccggcttaaggacacgccggagacattttccagataccccttccactttgagctggaggtgggccaccgtctggagggccgcaccgttcaggtgatgtggaaggtgaacaataccggctctgaggacctgctgttcatggcggggggacatcccgcgtttcgggtgcctgaggggcggaccatttacgactacacctttgaattcaacaagaccggaacgaaagccggaacctgccaggacgggctgcattaccaggctccgaacgccgacgggttcgagcaggaggatctgggcggaaccctggccctgaccgacggcagagtaccgctgacaaagggcttcttcgacagggcgctgacctacatatttgaccaggcggcagtgggaagcgtgagccttctgttggacggaaagccctatgtgaccgtgcgctgcgacgatttcccctacctgggagtctggaccgtggaaaatacgcaccccttcgtgtgcctggagccgtggtacggccggtgcgacgcagagggatataccggggagcttaaggaccgggagggagtggtgacgcttccggcatgggagagctgggagaagagctattccattacaatcggtgagtaacaggcgaaaatgcctgatgataaattaggaggaaaaccatgtacaagattgttaaggcggaatgcctggcagacaagatctacctgatggacgtggaagcgccccgcgtggcgaaggcatgtcagccgggagaatttgtaatcgttaagatggatgagatcggagagagaatccctctgaccatctgtgactatgaccgcgagaagggtctggtgaccatcgtatttcagacggtgggcgcatccaccgagcgcatggccggcatgaaggcgggagattatttccaggatttcgtaggacccctgggccagccctccgagtttgtgaaggacgatctggaggaagtgaaaaaacgccgctatctgtttgtggcgggcggcgtgggctccgcgcccgtgtatccccaggtgaaatggctgaaggagcacggcgttgacgtggatgtgatcgagggctccaagaccaagagcctgttgatcctggaggacgagctgcgggcggttgccggcaatctgtacgtgaccaccgacgacggttcctacgagcgcaaggggatggtgaccgaggtgatcaaggatctggtggtaaaccagggcaagaaatacgacgtctgcgtcgccatcggccccatgatcatgatgaaattcgtctgcaagctgaccaaggagctgggccttcccaccattgtcagcttaaaccccatcatggtggacggcaccggaatgtgcggcgcctgccgcgtcagcgtgggcggcaaggtgaagttcgcctgcgtggacggtccggagttcgacggacatctggtggacttcgatcaggccatgaagcgccagcagatgtacaagacggaggaaggcagggctctgctgagacagcgcgagggcgcttcccatcacggcggctgcggacattgcggaggtgaggaataatggatgttttaaagaaaataccggttagagaacaggatcccaaggtgagagccgccaattttgaggaggtctgccttggctacaatcaggaggaggcccaggctgaggccgcccgctgcatcaactgtaaaaatgcccagtgtatcaagggctgtcccgttgccattgacattcccaagttcatccatgaggtgaaggagggacagttcgccgaggcggccgccaccatcgccaagtccagcgcccttccggctgtctgcggccgcgtgtgcccccaggagagccagtgtgagggcaagtgcatccgcggaatcaagggcgagcccatttccatcggcaagctggagcgctttgtggccgactggtcccgggagaacggctttgtgcccgccaagcctgagaaaaccaacggcaagaaggtggctgtgatcggttctggccccgcgggattaacctgcgccggagacctggcgaaaatgggctatgaggtgaccattttcgaggccctccacgagccgggcggcgttctgacctacggcatcccggagttccgtctgcccaagctcggcgtggtgcgcccggagatcgagaatgtgaagaagttgggcgttgagattgagacaaatgtaatcatcggcaagtccgtgaccatcgacgagctgatggacgaggagggctttaaggccgtgttcatcggctccggcgcgggccttcccaagttcatgggcatccccggggaaaatgccaacggcgtgttttccgccaacgagtatctgaccagaagcaacctgatgaaggccttccgggacgactatgacacccccatttttatcggcaagaaggtagccgttgtgggcggcggcaacgtggcgatggacgcggccagaaccgcgctgcgcctgggcgctgaggtacatatcgtgtacagaagaagtgaggccgagcttccggcccgtgtggaggaggttcaccacgccaaggaggagggcatcatttttgacctcctgaccaacccggtggagattctcaccgatgagaacgactgggtaaagggcatggtggtgcgcaagatggagctgggtgagccggacgcttccggacgccgcagaccggtggagatcgccggttccgactacaccatcgaggtggacaccgtgatcatgtccctgggaacctctcccaaccccctgatctccgccaccaccgagggcctggagaccaacaagtggaaatgcatcgtggccgatgaggccaacggcaagaccaccaaggaaggcgtgtacgccggcggcgacgccgtgaccggagccgctaccgtgatcctggccatggaggcaggaagagcgggagcccgggggattgacgagtttttgagcgggaaataaaagatagatggaaatgaaggcggcgcgggatgcgccgcgggaataaagagacagggccggcccggctgagcggggaggccctgttttttgtgctgtaaccctatgttctgatatgggccgtcatcaggcggccctgtcatgctattgtccggccccgttctgcgtagtgccgaacaggtggggcgccatcttcttcagatggtgcatcttgctggtccgcagatgttcgcgcatctggttctccgcctcctcggcctggtgatgggtgatggcctggagaatcttcaaatggctgtcatgggagcggacgattccgtcggcccggtcctcggtcaggaaggtgatgcggaatatctggctggacagcggggcgtagagggtctgcagaatctcatttcgggagtagttgacgatattctggtgaaaattggaatcctcctgaaagagcttgtcgtactccttggtgcggatgtcgtcgttcatattcagccagcagcggttcagggcctgaatctggctgtccgtgatgttgatggcgcagagcttcgccgccagtccctccagatattcccggacgtcgtagagctggatcacatattcgtagcggatctcggacacgtagcttcccaccgtggggatggaggtcacaagtccgtccgcagacagctgctggatcgcctcgcggatgggggtccggctggaatttaacatctcgcacagctgccgctccaccagcatggtgccgggcgctaattgattggtgataattttttctttcagcatctcataagcgatctgcttcttggatttttctgcatgcgcagtcgtcggtgcactcataaacaactcactttcttacctcatatggtttcttgaagcagtccagcgcctgcgcggccgcaggcaaacattccggccgaaacgccgccggtcagggaattttgcttgcagcggtaccaaaggcaggcatgctgaaccgccacgtttatgtttctattatagatggaaaattcagaaaagtatagctgataaaaatgttggtcaaacagaatacaacggtgggcaatttataggtacagtatatagtattcgtcaaaaaaaagtcaacctaaaagctgtaagatgttgtaaatataaaaaagtaaaaaaaatacttgataattatatgcacatgtgctatattacaaacagttggtataccaatggaatacaaacggaatacagagggcgagttataaacgggcaggagaggaggagtatgatggaggcctttaagctgacggggaagacggccattgtcaccggagcgggcgcaggtctgggaaacagcatggccgcggggcttgcggaggcgggagccagggtggcgcttatcgatatccggccggatatcggggagattgcaaagcgcatgtgcggggacggcagggagcttgtgggaattcaggccaatctgacggaccgggaagacttgaaaagagggttcggggcgtgtctccggttgctgggaggagtggatatcctgatcaacaacgccgggatgcaggtgcggggcagagcggaggagattgctcttggcgactgggaccggctgatggaattaaacgtcacggctctctttgagatgagccggctggcggcccgggagatgatgaaaaagggctatggaaagatcatcaacgtggcttccatgctcagctttttcggcggcctcaactgttccccctacgctgcctcaaaaggggcggtagcccagctgaccaaggcgttttccaacgagtgggccgggcatgggatcaatgtgaacgctatcgccccgggctatatggacacggcgttaaacaccacgctgatggcggaccaggagcgataccgggagatcacgcttcggataccggctcaccgctggggacagccggaggatttaattgggaccgtgatttacctggcttcccgggcttccgactatgtgtcgggcgctgtgatccccatcgacggcggatatctggggaggtagacatggacagagagcaggttttagagcggatgaggcgggagaagatcatcgccattgtccgcggcgttgagacagcgtccatcggaggggtggcgctcgctctgactgcggggggaatcacctgcatggagattacggtggatcaccggacccaagacggaccggaggaaacctaccgctccatcgcctggctgcgggagcggatgggggaagcggtctgcctgggagccggtacggttctcgatgaggaagagacgcggcgggccgtggcggccggggcggattatatcatctcccccaatctggacgagagggtgatccgcctgaccagggaacttggaaaggtgtcgatccccggaacctttaccccctcggaggccgttcaggcttaccggtggggcgcggatatcgtcaagctgtttccggcgggacttctggggccggattacataaaagcgcttaagggtccccttccccatatccccttctgcgcggtgggagggattaccccggagaacgcgggggacttcatccgggcagggtgcgtttccctgggaatcggcggaaacctggtgaatctcacggcggtccgcgaaaagcggttcggggatctgacggcggcggcgcggcggtttgcagcgggcgcggcaggcttggagattgatcttattcatcaagataatcaagataaaaattaaattttaggaggtagttttatgagcaagtggcagattccttatccacaggaggtaaaggtagcggggtatatggattccgatgaacccatttatttccagaacatgactatgaaacagagcgaggagcgcttaaaggagaacgacatcctgattcttcccatcggctccaccgagtgccacggcgcccacgcctgctacggcgaggacacctttctggtaacccgcatggcggagcaggtggccaaaaagaccggctgcaccgtttcccagcccatctggttcggctcccacccctatcaccatatgggaatgcccggaaccattccgatcaatgagaacaccttctgcgattacatcgcccaggtgctggccggattctggaacgccggttaccgcaagatcatcctgttaaacggacacggacaggagtacgtgatccccaccgccatccatcagttcgccagaaagtaccaggttccggccgtgatgatgaacgtgaactggtactacgcgattcccgagtatctgaaggtgggcgatcccaagtgtaagttcgagacgcccttcaaccacgcggacgagcaggagacttccttctccctggccctgttcccggagatgatccacatggaggacgcgccggatacggatctgcacaccttcctgcctccgggccatatcgacaacgccgggaatatttacggacgggctgtgaaatggtactgccacgcaggcgccggcaccatcgaggtggtgggtaaccccgagggcgttgtgggcaaggcgaagctggccaccgccgggaaggctatcccggccactgaggcgctgctggattatctggagaagctggtcaacgatatccacgagaaatggccggcaggggttcttccggagtgcgacaaggtgacccagcggttcaccgaggaaaccctggaagatttgaagaaggggccgttaaacggaggaaagcatatttataccattgcggcttattaaaggagggcagcgacccgcaggttgtgccggcggctcattccatacggcaatgacccgcagctcattacacccgcattaacctttgcccgtctgcggcggcgggcaaagggcgggatcgggaatgaatctcaaaggagggattggaacttgaaggcatatgtactgaaagggccgggggtattaacggcggaggagcgggagattccccggccggggccaacagaggtgctcatccgggtgaccaatgtgggaatctgcggttcggatattcatctctacaagggcacctacaacgggccccagaattaccccattctgttcggacacgagtggtccgggattgtggagaaaaccggggataaggtgacaaaggtgaagcccggggacaaggtgaccggggactgttcccggtactgcgggcattgcgataactgcagcgcagatcgaaatctgtgccgtaccattgaaaagttcggcatcaccatagacggagcttccgccgagtacatcctgcgggatgaacagtatctctaccgggcggacccggaggcggatctggcgctgctggccctgacggagcccattgcggtggcaaagcatctgctggaaaagatattaaagctgggcggctcctatcagggcaaacgggttctgatctacggcggaggagcaatcggccaggctgcgctgctcctgctgcgtctgtactacggctgtgagcaggtggatctatccgatctgatcgaataccgcaccggactggccagggaactgggggcgaatattcccccggcagaagcccttaagtgggagctggaaaatgactatcccaacatgtacaacaggacaagatacgacgtggtcatcgagaccacaggcgtggcacaggtatttgcaaacgggctgaacctgttaaagccgggcggatacttaggctgtgtgggcatgatcaaaacggcggaaattccccagaagctgatcgtcaccaaatccctgaccgtcaccggcagcatcggaggcacggaggagtttgagggcgtgatcgcgtttatccaggagaaccgggacgcggtgcgaaagctgatcagccatgtgttccctgccgcagagacggatcaggccttcgccatggccaccgaggcgtcaaaggcaatgaagatcagcatcgcgctgtgacacgggtttgaaaggaggaggcaaatgaatataccggagaaaatgaaggcggcggtcctgttcggctataatgacctgcgggtggtggaaaagccggtgccaaggccgggaaaggatgaggtgctcatccgggtgaaagcctgcgccatctgcggaacggacccaaagatcatcgcccacggctgggagaactgcccgcccatgggggagtacattctggggcatgagtacgccggcgagatcgtagagttgggcgagggggttacgaaattcaaggcaggcgaccgggtggccattgagccccacaagggctgcgggcactgtgtgaactgcctgagggggtattacaccacctgcttaaactacggaaagctggaggagggacaccggcattacggcttcacggtcaacgggggttacgcggagtacgcggtctgccacatcaactgctgccaccgtttctcggaaaaactttcctatgaggacgccaccatgctgactacggcgggaaccgccctgtacggcatccagcgcgccggcggcatcgggccaggcgagacggttgcggtgatcggtcccggtcccatcggcctgatggcggtgcagctggccagggtgctgggcgcgggaaaggtgattctggtgggaacccgggattccaggcttgcaatcggccgggaggtgggcgcggacgtgctggtcaacagccgcaatgaggacgccgtggaagcggtgaagcgtctgacggacggcgtgatggcggacatggtggtggagacctccggcagcgccgcgggcggagcccaggcactggagctgtgcaagaagagcggaagggtggccctggtgggcatttactcggagccggtgacggtgaacctgaacaaggtggtgcagtggaacatgcagatcgcgggcggcaaggcggagggcgaggacgttttggaccgcctggtgcccctgatggagtccgggcagatcaagaccggtccgctgctgacccacgcgttttccctggacgacatcaacgagggggtccggacctacaaggagcgaatcggcaacgccatcaaggttgtgatcaggccttagactgggaggtggaacagtttggatcaagagatcgtattgcagatgaggggaatatccaaatcctttcccggagtcaaggcgctggacgacgcccggctggaggtgcgaaggggcgaggtccacgtgcttttaggggagaatggggcagggaaatccacgctgatgaaggttctctccggcgtctacttaaaggacgagggcgagatcctctacgagggaaaaccggtggagatccgcaatatccaggacgcccggaagctgggaatcagcatcatccaccaggaactcttcatgctggcggagcgcaacattgcccagaacatttatctgggccgggaaccgcttaaaaatccctacacccggcagattgacgagaagaagatgcgggaggacagcaaagccctgctggcccgcctgggcgtggaattgtcgccggacaccatggtgaaggagttgagcatcgcccagcagcagatggttgaggtggtgaaggccctgtccgtcgagacgaaaatcctgatcatggatgagcccacctccagcctgacaaagcgggagatcgacgcgctgttcgccattgtggagagcttgtgcgcccaggggatcagcgtgatctacatctcccaccgaatggaagaaatcttccggatcggcgaccgggtgacggtcatgcgggacggaaaatatgtgggcaccgtgagcgtgaaggagaccaacatggaccagctggtgaccatgatggtcgggcggcagatcagccagatgtacgggcggccggagcaccgggcgggcgaggttgcgctggagacaaaggatttgacgggcctgcgtttccgcaatgtgaacatccgggtgcgctgcggtgagattgtgggcatcggcggcctggtgggagccgggcggaccgagctggtcaaggctattttcggctacgaccgcattgagagcgggaaagtgttcgtacacggccgggagatgaaacggcactcgcccagaaattcggtggaggcggggatcggctttctgccggaggaccgcaagagcgagggcctgatccagcagcagcccatcaaaaacaacattctccaggccagcatgaagcggtatttcaagcgggggctggtggataaaaaggccgagaaagagctggcggagcgctaccgcggggagctcaagatcgcaaccccggacgtgaccaggcgggtgtccgccctcagcggcggaaaccagcagaaggtggtaatcgccaaatggctctgcacggagaaccggattctgattttcgacgagcccaccaggggaatcgacgtgggggcgaaggcggagatttacgccctgatcgggcggctggccggggagggctacgccattctggtggtctcctccgatcagatggagttgatcggcatctcggaccgggtgtatgtgatgaaggacggcgaggttgtgggagagcttggccgggaagagataacggctgagaatatcgtgtcctacgcggtgggaaaggaggaagcataagctatgaagtctaagggaatctggaacaaagtcccggggattttattcggactggccgctgtgtttgctttcttcgccgtgttcgcggagggtttcgccagtatgtacaacatgcagaacctgttaaaggactgcagcctgctgatcatcgtgtccctgggcatgaatctggcgatcatgtcgggaaaaatcaatatttccgtgggcgcggtcatgtctttgtgcggcgtgatcacgggaatccagctccagcggggcgtgaacatagggcttgccattctgatcggccttctggccgggctggctctgggtctggtctgcggttacatgatcgcctatcagaatttcagcgactgggtggttacatacgcatttatgggcatcgcccagggcctggccctggttgcttcggacggaaacaccattccgggattttcgaacgccttccggtttatcgcaacggggaagatcttcggaatctacaccatgattatcattgcggccttgctgtgcctgcttttggtctggctgtccaccaggacaaaattcgggtacgacgtgtactccatcggcggctcccagcagagcgccaggctggcgggcatcaacgtaaaacggaatctgctgtggattttcattatcacggacctgctggccgcggtcagcggaatcctgctggctgccaaatccaattccgccagccccatcggcggccagggctatgagtgggacgccatcgcggccgtgctgatcgggggaacgccctttgacggaggcaagggtaaggtcagcggctgcatcatcggcgcggttctcatgcgcaccctgcgcaacggcctgaccatgatcgggttgtccccctactggcagacctttatcatcggtgcggttgtgatgttagtcatcgtggccgacgggatcaacgagtaccggaaaaaaacacaggcggcgaggagggtttataaatcatgagacaaaaagtgctgactacgatttttaaatactcccaggtgctgatgctgcttgtgattatcatcggattttccctgactacagagaatttctgcacgctggacaatttcaccacggttgtcatgcagcagcttccgttcctgctgatcatttccatgggtatgaccatggccatcatcaccaagggcatcgacctgtccatcggctccatcctggctctgtcctcctgcgtgggagcgtattttctacagaaggggcaggatttgaccggggtgctggcggcccttctcatcggcctggctctgggaatgatgaacggcctgctgatcaccaaggttcacctgatcccctttatcgccacctacagcatgaacctggtggtgcggggactggcctacctgtttatgggcggtctcttgtattacggcttcagcgaccggttccggagcctggccaccggaagctttgcggggatttccaacctgctcatcatttccatggtcctcttttttgcgctgctgtttgtgttaaaacggacggtgttcggccggaatgtatacgcaatgggctttaaccgcaacgccaccaccctgtcgggaatcaacacggaccgggtgctgatcagcatttacacggtcaacggcctgctggccgcagttacgggcctgctctacatttcccgcctgaacgcggcggagtccaccatcggaaatgattttaccctgaaaatgatcgccgccaccctgatcggaggcactccgttctccgggggcaagggcggaatcgagaaaaccattgtgggcgttttgattatgatgttcttaacgaacggcatgaacttaaacagggtgtcgtcgttatggcaggatgcagtttttggcgcggtcatcgtgctgtccctgctgatcaacaagctgggcgagaagatgacgggaagccaggagctgtaaagcacataaaccgtaactatggagtaccacaatagttacagcaaatccagaaaaggagaagaggaattatgaggaaaatgagaaaatgggcggcgttatgggtggcagcggcactggtgctgggcggatgttcctcaggagcgggcggcggggataccaaggcggatgtgacgccggccgccacagagaccgtctccggggcggagtctaaagaggcaaatcccaaggaagcggacggggccaaggcagcggacacctccgcggcagagagcggaagcgcccaggcgggggagacgggcgcagcggtgaaggccaacgggaagtacaagatcaccctggtggtcaagaatctgaccaaccccatgtggatcgccgtccaggagggggccgagaaggcggcggcggaggccggggtggacctgaccgtgctggctccggctaccgcggacagcaacgaggagcagatttccttgatcgagcagtccatcgccaagggcaccgacgccctggtggtgattccggcggactccgtgggcatcgtcccggcggtggaggcggccaacagcgccggtatcccgctgatcgacgtgaacaccaagatcgacacctcgggcggctgcaggatcgagacctttatcgcggttgagaactataccgccgccgtgtccgtggcggagaagctggtggagatgctggatcagaagggcgacgtgatcattctggaaggcaaggccggggcccagagctctgtggacattgtggccggagccaacgacacctttgccaagtacccggacgtaaacgtggtggcttcccagaccgcaagctggaaccgcaccgaagcatataacgttaccctgaaccttctggaggccaaccccggtgttgcggcgattttcgcggccaacgacgagatggccatgggcgcgctggaagcggtgtcccaggcaggcaaatccggtcagattctgatcaccggcctggacgccaacgaggacgccaaggcggcggtggacgccggaacattggcaatcacctgcgacaagaacggcatcggccagggctacgagggcgtgatgaaggctgtgatgctgctcaacggtgaaaccctggagcccaactatgtggtggacacctatctgtacaccaagaattgatgaaattttgagacgaaaggtcggagggcaatgaaacagtatattatcacagtggacggaggaaccaccaatacccgctgcattttgtgggacgaaaaccggaggcgcatcgcccaggagaaccgcccggtgggcgtgcgcaacacggccattgacgggaacaaccggaagttaaaacaggcggtgaaggagtgtctggacgccctggtggaaaaaaacggcctgggctacggggatatccaccggatcatcgccagcggcatgatcacgtcggacgtggggatcgtggtggttccccatctgacggccccggccgggcttgaggagctggcggcggccaccgtggccatcgagctgccggaaatctgtccggtgcccatttactttatccctggaatcaaaaattcggacggcccgttttcatttgagaatatcgaggctatggacattatgcggggggaggaggtggagagcatcgccgtgatggagcagtttaagagcgggcggccccttctcctggtgctccccggctcccacaacaagttcgtgtccgtggacgcggaggggaaaatgaccggctgcctgacttctatctccggtgagcttctggcctccatcaccaacgacacgattatcgccaagtcggtggggaaacagttcgtggaggaggaaacttacgaccgggagtggctgttaaagggctacgacaacgcaaagcgcaccggtcttgggcgcacctgctttacagccaggattctgcaactgttctacgaggatgcgccgccaaaaatcgccaacttcgtgctgggatccgcgctccagggagacgtcacggcggtgctgcactcggacgccctgaaggtgagtccggacaccacggtggtggtgggcggcaaaaatccgctacgccaggccattgtggatattttggagcacgaggggtatttcacacggattgagacctatgtgccggaggagggaatttcgctctccgccctgggagcttatctggtagcggagaagaacggtattttataggaaggaacgagtgacatgttggttgtgataacggattaccagtacgacaacatcgatgcggagcgcaggatcatcggggaagccggttttgagctgagggactatcaggtgaaggaaacgaaagagctgattcccctggtgaaggaagcggacgccatcgtgacccagtattcggatgtgtcccgggaggtgatcgggcagcttgaacactgcaaaatgatcatcaagtacggcatcggtgtgaacaatattgacaccaaggcggcgacggagaaggggatctacgtctgcaatgtgccggactacggcgtggaggaggtttcagaccacgcggtgaccatgatgctggctctgggaaagaagatgcagattctggaaaaagcgttccgtgagggggactggggctactccagcaccatgcccctgtaccggctgcgggactgcaccctgggtctggtggggttcggccggattccccagctggtggcaaagaagatggccggcttcgggcttcggattctcgcctatgacccctttgtggacgaggagaaggccagggccatgggcgtgagacccgtggatctggagactattttgcgggagagcgattttatctccgtgcacgtgccgttaaacgagggaaccagacatctgatcggccgggagagttttgagaagatgaagaataccgcttttgtggtgaacacggcccggggcggcgtgatcgacgagaaggctctggtggaggcgttaaatgccggtgagattgccggcgcgggagtggacgtctacgaggaggagccggtaagcccggacaatccgctgcttcacatggacaatgtgatcgccacccctcactgcgcgtggtacagcgagaccgccatcacgaccctgcagaggaaggtggcggaggaagtggtgaacgtgctgcaggggaacgagccgtttaattgtgtgaaccgggggtcgttgaagcggtagagagcgtggaatgcggcgcggtttggcaagaggcggaagttgagagaaaatagcggtttaaggcggcggcctgcgcggggagagattccggcgcgggccgctttgccgttcccagccgctggattggagctccccaccccggcacgtggatcagcaagagtctgtgattggggcaggcggtgttttcacaaaaggcagcagcagatatatgaaaagtggaaatttgattggtctgatccggatatacaggattgtatttttttcgcattgtttgcagagggttctaaaatgactcagggcataattgcttgcagggaatataaaaacacagccaaaatgggaggatatatagagattgctctggtagaagcgaatcctcgaaacgttagagagaaggggagatataagggggtcggggcgcatttatttgcgattgcgagtcagattttacatgcaaatgtacttcatgatcggatcataagtatccggcatgccttatttgataataggaaagaccttaccaaaataaagttatgtaaattaatggatctgctgaagcaggacatggaaaatagaaggtgatgagaacaggttgatatagggcccttcttccaattcatcattgttgcggtcatcgtcttcaattaaaaagtaatgtatatccaatcaatcagagtcggtcaggtacccgccttatttcccgaaacgccttaagataatcccgcctcgcggggttccaatttcccattttctatgatacactatacacagcggcctttttcaagggcgctatttaaatgtgagataaatctgaaaagcaggacgtgattggatgaaacggaacatcgatttgctacatggaaatattttgacttctctgaccgagctggcggtgccgatcatggcgacctccatggtgcagacggcgtacagcctgacggacatggcgtggatcggcatggtggggagcgacgcggtggcggccgtgggcgcggcgggtatgtacacctggctgctcaacggcgcggtggccatggccaagatgggaggtcaggtccgcgtggcccaatcctacggcgagggtaaggtggacgaggcggtggagtacggcaagggcgcggcccagctggcaatcgccatggccctgtccttcgcggtgctggccaacgtgttcgcctggcagctggtgggatttttccatctgaacacggcctccattgtggcaaacgcggtcatttacctgcgcatcgcctgcggcatgctggtgttttcccacctggggcagaccatgaccgggctgtacaccgcggtgggcaacagcagaacgccgtttctggccaacggcgtgggcctggctctgaacatgatcctggatcccatgctgatcctgggccttggtccgtttccacggctgggtgtcgcgggcgcggctatcgccacagtgacggcccaggcggtggtgctggcggtgctcctgatctccgcgcggaaggactccattctctccaggcagctgcggatctggaaacccacgtcccgcaggcattttaaaagtattgtgcggatcggttttcccaccgcgatccaggatatgatctattgcagcatctccatgtacctcacccggtttgtgaccagctggggcgacgcggcggtggcggtgcagcgggtgggcggccagatcgaggccatttcctggatgaccgccgagggcttcggcacggccatcaacgccttcaccgggcagaactacggcgcggggaatttaaagcgcgtgaaaaagggctacaccacggcggcggggctgatgttcgtgtggggcattttcacctccctgctgctgatttttggcgccacgcccattttcagcatcttcatccatgagccggaggtgattccggcaggggccagttacctgcgcatcctgggcgtctgtgagatgttcatgtgcattgagctgatgaccgtgggcgctatgtccggtctggggcgtaccatggaggcttccgtgatcaccattatcctcaccgcgctgcggattcccatggccattgtgctgggaaccacggctatgggactggacggcgtgtggtgggcgctgacgatttccagcataatcaaggggatcgtgttttttatttattatcagcggattatgcgcaggtggaaatgactacagcagctcgtcctccccggcagcctgggaggacagctgattgacatagcagacgccttcccgggcggagcggaggcactcctcgatcaggctcttcgtgtccatgaactcctgcatgcctagaacggtcagaagcatgggcatgttgacgccggccatgatatggacacggggatccgccatgaattccgaacagagggtgcagatgctcccgcccagaacgtccgccatgatgatgacgtcgtcgtccggggcgcagctgtccagcttctgccacagggcggcccgtatatcgtccccggtggtggtttcgcacatgcagagactgagaatatccagtccgccgcccaggatcagagcggccgaattgataatttcccggctgaaatagccgtgagttgcgacaataaagtgtttcataagattcctccttgttctgcctcattggcattcttgattatttcgtaaatgattccaatttcttcttcattgacttccacaccgtatttctgggccatgatggaaaatgcccgtttgaacaggaccgcaaagtccggactcagccggttcatttcctcaagcccgttgtattcccggattgggttggcccgaaccaggcgctccatcatggcgctgatatggataaacaggttgatttttaggtcgttgggcagggtcaggttcatgtaccgctcaaagcgggatatcagaacctctatgtcctggagcagcacccgggcatcgatgatggtgatggaccccaccatgttttccagcgaaaaattcgccagcagccggttgttgatgcgctgcatgtggtctttcgtcagactgtccccgaataaatgttccaggcttccctcgtcgcgcccgagaatcagctgttccacggagataaagggcacgtcctttatgcgggggttatctgttcccaccacggccagcaccgtaaattcccgtttcagccggttctggaccgcgggatcttttaagtgatggaagtccatggaccggaagcgcagggacggaacgtcgaaaaatccctcctccagcatgtgttgtattttctgggcagtgccctccccgctcatgcacgtggtcaaaatcaagcgctgcttctgggtcgcaggccggaaaatacggaactccggcagattattctggatggacgcctccagcagattatccagggattcgtgctggatgatcctgtttccgatatccagagccagtccagtactgacattggagataacaccgatggttatgactgagttttccagttcctggtaaatatctttcagggaaccggtgtccaccagaagcaggagttcctggcctgtctccatctgccgcagatgtttattgatgatatccgtcacctctcccggcgtgatatccatgggcatatccactgcctcaaacacctgaagcttgaaaacgcggttgcagacgttggcgatgctgctggctgtggagtagccgtggcagaggatcagggaacgggtcctgctgacaaagcttctgacctggatattccggaaaaatacggtaaagaacagcttgtccttctgggtacagcgctgttccaactgctgctgcaggttcacggacagatgttcgcccagacggctttcatcggggtaaacatcccttatgtactgggccagctggtagagctctctgcagccgtccgcctcgtcccaggggcaggccctgcggtaggtcagatggagtgccaggctgaaacggggcccggaggcaaccgtcaccccggactggaattccatctgccggaagacctgttccagaatttgatccaagtagcttaaatcctctttgccgtagttctgtttacggaaatacagctggtccagataacggtccaggacccggtccagctcgctctcaaactgacgccgtccggtctggcctgtctttacaagctgataggcctgcagaaggccggaaaagaactcgtcctccagggctgctccgggatcgctcaggcgcaccaggctgttcacccgggcgtcgggggcgatttcaatctcgccggactgctccgatccgcccatacgggcgggaatctgagccagcagataggccggataacaggcgcgggtaacccggatgcggctgtcccggctgttgatcagagcgtttccgcatacatactggacaatgttgatcagctcgccgatgttgccttcatactggaattccagcatgtcggagagtacggtgcgactgacaagcacgggctggcccagatttttggcctcgcggataaaatagaggtagatcatctggagcttttcctcgcgcacccggtcctttaagtccgggatctttacgacgatgggaatgcgccggaacagggtttgcagcatatagccggacgaatccagattgctggcgaaaatgaagcggacccgggaggtgcgccacccgctcgtctcccccatgcgccggaacacgcctttgtccagaaaggtaaacagtttttcctgcccctcagggctcagccggtgaacctcatccataaagaggatgccgttgtccgcgtcctccagcaggccggtcttgtcgcttgatgctcctgtgaagctcccttttatgtagccgaacagattggaagagagcagctctgcgttgttgtagtattgggcgcagttaaaggtcagaaagggagcgtcgggcttcaggatcccctgggagactgcatactgccaggccagctgggcgatatggctttttcctacgccggtgttaccctgaatcaggatcggaaggccgtttgggggatatttcacggcaattttcatctggttgatgacttggcgcaggctgccgtgggagcctgtcagcgaggaaaagacatcctgctcctcgcaggcctcggactttaagcccctcacctcctccggcgaggagaagctgtctgcgtaaaccggaacgcccagcgcctgctcgagggcggcccgttccagaaaatagaccggtctggagttgattttaaccaggctgccctccgccgcgagctgatttaaatatccgctgaccgtattgcgcttcagcttcataacagcggcgatctgttcggctgagtatatagacatgtcctgacaacggtcaaattccagggtgattccggcgatgtattgctgaatattgtctttcaccattcctgctttctcctttcatggatataataagcaatctttatgccaaataaaatcatggcgggataccctctgtttttatttaataatgtaccgtagcgcccgggtttttacaagaaatatgtacaaataaaccatattttgtcacaaaaatgcagaacctcagctataataaaagcggtagcactgtcgaaaatcgccttcggcagtgtcgaaaaaccggccggacaggcaggtagcccctgtcagctggaaaaaatatttgactttttaatttaatataaggaagctttcacttaaaacacaaagaaaatcgcaattttcaatccgattatcaaaagttggcacggaaattgcattaataaaaagtgagcgctcgaaaaaagagattggaggtaaatgctatggtaaaacttttaaggattgacgaccgcctgattcacggacaggtagcgtatggatggacccaggcgctgggggtcagcgtgattctgattgtcaatgacgacgtggccgggaatgaaatgcgcaaggtcgcctacaacgtaggcaagcccgcaggctgcaagctgtatttcagggatgtgaaggaaggggtcgaggcagtcaaaaagctggaagcctccaatcacaagtgccttgtattggtggacaatgtgaaggacgctctgacgctggtaaaggagagcggctgtatcaggacagtcaacctgggcggacagcggatggcggatggaaaacgcttcatcacaacgctggttgccgtggacgattcagacattgccatgttaaaggagatcgaggcggccggaaccgatgtggaggtgcgcaagctgccttccgagacgaagcgccgcctggaggaattgatttagtgataggatgaggaggataaaaagatgtttggaaccgctttgctgattggcctgatcggcgccctgtcccagtgggagagccggatgatgggcgaaattaagctgtcccagccgctggtaacaggcgtgctggtgggaatcgtgttgggcgacattaagacgggcgctatgatgggcgcacaattccagctgctctggatgggaatatccggcgtgggagctacgccgatgatggatgtgggcgtaggcagcatcctgggaacctcgtttgcgattctttcgggcgcgggcatcgaggtggccctgacactggcacttccggtggcgctgctgtcccagtacataaatgtgggcatccgcacgctgatcaacggatttatgcccaaagcggacgcttatgcagctgagggaaatatgcagggcatggccagaattcactggttcggcgcctccctgttcttcctcctgggcttcatcccctgcttctgcggcattatgttcggctccgaggctgtaaacgcctttgtggaaatcattcccacctggatcaccaacggattggccgcctcctccaaactgttccctgcgctgggctttgcacttctcatgcaggtgacaatggggaagggtatgatcccgtactttattctgggctttgcggtcagcgcatacctgggagtgccggtcaccggcatcgccgtgattggtctggccatcgccctgattgtgttccagtttaaccagagcggaacaaacgctgagatagaggaggatattttataatggctagggaaaaactctcgaaaaaagatctgatgactgtgttctggcgctcgtttgccatcatgggttccatgaactatgagcgtatgcagggcctgggctatgcgtggagcctgttcccctgcctgaagaagatttacaaggacaacaagaccaagctatgcgacgccctgtcccggcacatggccgcgttcaactgcgccacggctcccatcccctttatcatgggcatcaccctggccatggaggagcagaacgcggacaatgacgagttcgacgcctcggctatcagcaccatcaaggtcgccctcatgggcccgttggcaggaatcggagatgcctttttctggggcgtgttccgggtggtatctgcgggtatcggcgtgtccttcgcgttgagcggcagccccctcggagccctgttcttcctgatcctttacaacaccccgaatattctgtgccgctatttcgggctgtttctgggctaccgggaaggaagctcgctgctggaaaaatggacggcttccggcctgctggaccgcgtgaccaattccgccgggatcctgggcgtcatggtgatcggctccatgattgcgactatggtcaatatcaccacgcccatggagctcaacctgcagggcgcggtggtcaatttccagtccgtatgcgaccagatcatgcccaagctgcttccgttagtgacgaccggagctatttacggggcgctgaagaaaaatgtgaaaaccggtatgattatgctggcaatactggcgattggatttgtgggaagcgccattggattattataatattgagtaggtaacaggaggagatcattatgttacagaataaagaatactacgacgagcacggaaaggcgaatattgccttaaaaaataccattgagcaggtggcggacacaatttgccaggaaggattttccaatatctttttcgcaggctccggcggctccatttgcatgctgatgccctttgtggaaatcctgaaaaaactgacggatatcacatcctacgctgaggaagccgcggatctgaaggtggcggattaccggcagctgaccagggaatcactggtgatcgtggtctccaagacagggaacgccgaggagcctgtggagctgatccaggaatgcaaccgcagaggcatccgcacagtgtccttcgtgggcaacgacacctcgccggtttatctggaatccacctataaaatctggatcgatgaggacgtaaacgccttccgttacatgcagatttactacttcatgttccgcctcatgcacaacaaggggtatttcccgcagtatgaagacttctgccgcagtatggaggttctgcctctggcgctctacgaggcggcgaaggtgttcgagcccacggcgtggaaattcgcaaaggagtacaaggacgagccgtacatcctgttcgtgtccagcgggatgggctatcccgaggcatttcgcttctcctcctgctccgtggaggaggtatttcacatcaagacccaggccatgaactccgcagagttcttccacggctgctttgagattgtagacgaggacacggcggtggttctggtcaaaaatgaggacggcgccagatccgtggacgagcgggtggagcgtttcctgaaaaactatgggaagaagtacattatcgtggatatgaaggactttgctatggagggaattcgggaggaataccgttcctacttcacgcccgcgttcctgaatatgatcttcggtggcctgaccttctcgtgcctgcacgagaccacgggccttggctttgacacgcggaaatactacagagtggtacagtattagggcgagtaaagaaattaataaggatgtgatggagtaatgaaggaaatcgatttttatgtaaaagattcgctggggctgcatatgcggcccgcggcggccttcgcaggaattgccaaacgggccaagagcagtattttcattgagaaaaagggtggggagccggtggatgctcggatgattctgatggtgatccggatggggatcaagcaggcggaggattttatgatccgtgtggaaggcgaggacgaggacgagatcagccaggaaatcaccgcgctgctgggagagctgtaaaataacgctgggacagggaatgacattttcctgtcccaatttttatgttgaattaagaaaaaactgcttgtaaaatgccactttttgtgagagaatggagataagtatgatgtgataaatttaacaaagggcactgtacttgattaaattcatttttgaaaggagttttaacacatgatttattcacaggaagtagaagagatgtgcacagttgcacagggcgttcatcatggcgctgctccaatcccggaagaagctaaatgggtaaaatcaaaagagatcaaagacatttccggcctgactcatggtgtgggctggtgtgctccgcagcagggtgcctgcaaactgacactgaacgttaaggagggcattatccaggaagcgctggttgagaccatcggatgttccggtatgacccactccgcagctatggcagctgaaatccttccgggccgcacggttctggaagctttaaatacagacctggtatgtgacgccatcaacaccgccatgagagagctgttcttacagatcgcttacggcagaacccagagcgcgttctccgaggatggacttcccatcggagccggcctggaggatctgggcaagggcctgcgctctcaggtgggcaccatgtacggaaccttaaagaaaggtcctcgctatttggagatggccgaaggctatgtaaccggcatcgcgctggatgcagacgacgagatcattggttatcagttcgtaagccttggcaagatgactgatttcatcaagaagggtgacgatcccaacaccgcatgggagaaagcaaaaggccagtacggccgcgttgccgacgctgttaagattatcgacccgcgtaaagaatgatgaagaccaattaggaggataagaaaatggcattatttgaatcttatgagagaagaattgacaaaatcaattccgttttgaatagctatggcattgcttccattgaggaggctgagaagatcaccaaggatgccggtctggatgtttacgatcaggttaagaagatccagccgatctgctttgagaacgcttgctgggcttacaccgtaggcgctgcgatcgcaatcaagaagggctgcagaaaagctgccgaggctgccgctgcaatcggcgagggcctgcaggcgttctgtattcccggctccgttgccgatcagcgtaaggttggtctgggacacggaaacctgggcaagatgctgctggaagagggaaccgactgcttctgcttcctggctggccacgagtccttcgcagccgctgagggcgcgatcggtatcgcagagaaggctaacaaggttcgccagaaacccctgcgcgttatcttaaacggtctgggaaaagacgccgcacaggttatttccagaatcaacggctttacatatgttgagaccgagatggactactacaccggcgaagtgaaagagctgtggagaaagtcctactccgagggcctcagagcaaaggtgaactgctacggcgccaacgatgtgaccgagggcgttgccatcatgtggaaggaaggcgtggacgtgtccatcaccggcaactccaccaaccccacccgtttccagcatccggttgcaggcacctacaagaaggaatgcgttgagaagggcaagaaatacttctccgtagcttccggcggcggcaccggccgtaccctgcatcccgacaacatggcggcaggcccggcttcctacggcatgaccgacaccatgggccgtatgcactccgacgctcagttcgcaggttcttcctccgttccggctcacgttgagatgatgggtctgatcggtatgggcaacaacccgatggttggcgcgactgtggctgtggctgtggggattgaggaagcggcgaaggctgggaagttctaaggaacaacgtaaaatcaaggatttaagaggctgttaaaggttagaaaaagtgtaaaaaagaacaagttatgttgattatttgttcactacttgtttaccgcatttgttcaccataaatagcattgcgagcgaggaggattaactcaaattctcctcgcttattttttcgaggtcagcccggagccattctatgtcacgtacggtgtaggtggattctgtaatgtctttaaccatatggctaaccattgccttgatggcgtattcatcaacctcggatttttttgccatggtgacgaaggtcatgcgcgggtcatgcgggtggtggagcgggttcatatggagtgcctgtataactttatcaaagcggtggtggtacttatcataggttattttgtatgagccggaataggtttggcccttatcattaaaaaggtattcgctgttgagcgatactgcataatcgtagttctactggaccagacgtcgaattttgctgtgtatggggaccagtcgctgtttccccgcttctgttttcattcctgcctgcatataccattgagacagattgatttcatctaattggagtgtggcaagttcctgcgggcgccaccccatataagtctgaatcagaacccagtccacaaagggtagtttaccttcactgttccataacaattttaattcggcttttgtgaatggaatatgatcccgcttggtcttttcctgctcttttacgatcctcaagtgtgagatgcttctggttaccaggaaaaaatttgctcataaaaatctccttctactgctgtcagaaggagatataaagatatcatgtatgtatgaaagcgtaaatattaactgtgcagaagtaaactctaccagacaaatggggagtggaatttactttttatttcagtaaaataaactagaaatcacatgatactttgatctttcacatttattactgtaatatttttataaaaaacaaaacgggatgattctatggcttctaaaatccgtatcctattgatagaacgaaatatgaagataaaggatttggcgaaaatgcttggatatagcggaaataatttgagcaataaacttcgggatgataatttttcggagaaggaatttaaaaagattgcggagttggtggattgtgactttgacgctacgtttactatgagagatacagacaagataatatagaggcgtaaatgatttggggatttttggttgatgtttatttaagaacgtgatgttaacatcacgttgacatgtattttcccaaattgagactatgagatataaacgacaggaagcaagtgtctgcttgaactgaaacagaagaaaaagaaaaggaacgtaaaagggaggtagtatttacctcaacttactctagtcaaaatacgatgtttgtcatttggcggaagagattatttattatcttagtgaatattactatatatggtattggaaccgtgtaacaaatttaatgaagaggaaatagtatgcaagagtctttatattcttttagatgttcaatagattataaatttagaggagcagatcggatacaaaaacaaaatgcattattagaagatataggaatagatatagatttttcaaatgatatagcaactgatattcgctataaatgtagtgaattgggaacaaatggatgggttatttcgccattttgggaacctaataatggtgaaacttggtacaatacatggtatgatttgttgataagtggagaaaaagaaaaaataaaaggtttctttaaggataatgattataaactattgaatcatataaggggatatgctagatttgaagtagaaaagtataattggtggacagaggcagaagatttatttgataagaaattttattttggttgtgcgttaattttagccgcaatattagaaagagagattaggaaatgtccggttgataattggcggcatcaaattacacgctactttaaagattcggtgactgataaaatagttcagatatatcaagatgataagatagagcctatcagtaaatatatagataccttgttgttaataccttcgctagacggttttataaaatctttttataatagtggctatacttttgaaaataagatagaaccaaattttgtggaaagaaactggcttatgcatggaatgactaatagaaagatttcagaagaagattgtattaaactttttaatgtgaatggtagtttatgctatgttttacatgcgttatttggtacagattatagacaataattttggagacatgtattatcgagtcattagtaatgcagagtagcacacccgtagcgcacaaacgcccctcaagctcttgaaaatccaccctttactggttcgattgagatggcagcaaaagaaggaaaattttaagataagaatatataaaatatggatttttaagtactgcactggcggaaaatggctggtgtagttttttaaacgataaatgtcttgaattatttatagatagtgaatctttttagattctgtgctatactattataaaaaaattagaaggtaattttttatattaggaattacaaggagtaatgatatatataattctttaattaagggggaaaagatgagtgttagattggttaagtattcttatagatttgcggagcaggtattcaatggtagactgaatttaaaaactgaaatggaagacattattttagaagcttgtaaagacctaacaatattgagcagacctaatttaaataaaatacttgatgaattatttgttaataaaggctggcaacgtcaggcacctgtattttcaagtggtgaagccgcatatgcaaaaatggactttttaaaggaaagaattggtgttgaagtacaatttgggcatgcatcatttattggaattgatttattgaaaatgcaaattgcttcatattctaatttagacaatatagattttggtgtatatatagttacaacaaataaaatgcagaaatacttgaaagataattataagttaaagtgggattgtagtttatcctatgaaaaagtcattaaatatttgccacatataaagagcgcaattcaagtacctatttatgttataggaattgatatttaagatgaattctatatagctgtttttgtattgccatgagcttttctctatagtgctcagtagcacacccatagcgcacaaccctcctcaaacccttgacccctcccttcaccatttcgattgaggaaacggcgaaggctgggaagctctaagaaaaagcataaaaatagccaggaaagcgattatgtagtccatataagcagccgtctatgcggcagaacgtgaaaaaactttaaatccaagggcttgccaagacaaaaaacgtcatggcaagcccttttccacatcacacaaattcccgggtaatgttttttaaccacttataacttttataatgtctgtaaacaaagggtatcttcacaaattcatcggtacaaatcaggaaatacacccacatgggaggcagttttaaaacaaaggctgcaataaaaccaagcggcacggcgtatccccacatgtcgatggtgtcgcagataaatccccatttggagtcgccgccggagcggaatacgccgcagattaccgcagagttcacggcctgtccaatcacgtaatacatattgatcaataacatgatatttaagtaaccctgagcggccggcgttaaatccgccatatgcagaaacagcggtttcagaaggaaaatcacgataccgcccaggataccggcaattaatgtgagcctgcaaaaacgggaagcgtctgcttttaccgtttccgtatggcccgcgccgatggattttccgaggagaatcgctcccgcattggcgatgccaaagcaggcgaccgtacccagattgcgcgccacgacgacgacggcgttggccgccaccatatcgcttcccaggtgtcccataatgacggagtacatggaaaaagcgacgccccatacaatctcattcccaaaagcagggagagagtatttaaaaaagtcagaagaaagaactttatttttcatccaaagtgtccagatccgaaagcgtatggtccgagaatttacattgtcaagaaggcaaatgaaaagttcaatccctctggaaatgctggttgccagggcaacgcccattatgcccagtttgggagccccgaaaagtccgaatataaacacggcatttaaaatgatgttcagaaccaaggcggagccgttggccgcagtggcaaatattacgcgttcaatggcgcgcatggtacataagtacacctgggaaatgctcatgaataggtatgaaaaactcaccacttgaagataaggaataccggtggcaatgagcgcttcctcattggtgaaaatccgcatcaaaagagagggagaaaaacaggccaggataaaaaaggcggcggataccagaatggaaagccgcatgccgatccccatgatctgttcaatggtcagagtatcctgcctgccccagtattgggccgccagcatgacggtcccggaggaaataccggcatataccagatttaaaataaacatgatctgactggcgagagagcctgccgccagggcgtcctgactgacaaagccaagcatgattacgtccgcggagctgaccgcagtggtaactaagttttgtaaaacaatgggaattgcaaggcgggccatggttcggctaaagttaggactgcctgatgtaaggtttgtctgcataaaaacatctccgtgtattctaaaatgaaatcagactgtttttcccaacggcatatgcggtttacgcgaccggctggcagagattgtggccgcttttcccgcaggatgacgataagagttacgtttccttattatagaaagagaatgcaaaaaagtcaatatcatgtttaaacaactttttcaaaaaagcattgacatgttcaaacaagtatgatataacagaatcaagaaacatgtttaaacaagtttgcaaaacaggtggagggatcagaggatgggaagatatgcagaggacgcaaaagagctgctgcgtctggtgggcggaagagagaacattgcggcggtttcgcattgtatgacaagaatgcgttttgctctggcggacccgggaaaagcggatgtgaaagcgattgaggccatgaaggttgtgaagggaagctttacgcagtcggggcagtttcaggtgattatcggcaatacggtagctgatttttacaatgactttgtaaaagaggcggggatcgaaggggtgtcgaaggaggcggtcaatcaggcggcaaagaaaaaccagaacgtgctgcagcgggtggtcaccgcgctggcggagatttttgcaccgctgattccggcaattattacaggaggtttgattctcggcttccgcaactgtattgacagcttgtatctgtttgaaaatgggacgaaaaccttgtgcgacatcagccagttctgggcgggcatcgacagttttctgtggttgatcggcgaggcggtattccatatgctgccggttggtatctgctggtcggtgacaaaaaagatgggcaccacgcagatgctcggcattgttctcggcctgacgctggtatccggacagctgctgaacgcttacgcggttgccggcacagtggcggcggacattcccaagtggaattttggcggcttccaggtcaatatgatcggttatcagggccaggtcattcctgcgattttggcggcgtttaccctggtttatctggaaaaattcttccggaagatcacgccccaggtcatctccatgatcgtggttccgttctgtagtttgttactgtcggtcattgcggcgcattttatacttggccccatcggctggaagattggagcggcggtttccgcactcgtattttccggaatcaccggaacctttaaggttgtgtttgcggcgatttttggcactatttacgccccgctggtcatcacgggacttcatcatatgtccaatgccattgacctgcagttgattgcggattacggcggaaccatgctgtggccgatgatcgctctgtccaatattgcccagggctctgcggttcttggaatgatctggctgcagaaaaatgatcccgaagcacaggaagtgaatattccggcatgtatttcctgctaccttggcgttacggaaccggccattttcggtgtgaacttaaagcggggatttccgtttgtctgcggcatgattggctccggtattgcggcggttgcctgcgtggccatggggacaacggcaaatgccatcggcgtgggcggtctccccggcatcctgtccatccagccccagtttatgggttcctttgcaatctgcatggcgattgcatttgcagttccattcctgctgaccgcaatcgcgggaaagaaacgtctgcaggcggttcctgcgggtcagacggcagagttggcagaaatcgccgcagtcgcaggttcaagcgccgcggcgggcgttatggctgcaaaaatgggggaaacagaagcaaatgaaaagccggcgggaacattaacggcatttttatccggaacggccattcctttagctgaagtcaaagatggtgttttctcagaaggaattttaggggatggtatggcgattatcccggaaagcgatacgctgtacgcacctgcggacgcagagatcgcggcgcttatgccggactcacgccatgcctgcgggttaaagctggaaaatggtatggaggtactgctgcatatcggaattgatacggtcggcatgaacggggacggatttgaatatctggtgcaggaaggccagaaggtcagcgcgggaacgccgctgataaaatttgaccgggctaaaatcaaggcggcaggccacccggatgtcacggtttgcattatcagcaatccaggaaacgcaaaggcgatccggttccggaccggaatgaaggtaacagaaaacgaaaccgcagtggcaacgttccaataaagggagatacagggaggcgcaaaatggcagatttcagcaataaagtagtttatcagatttatccgaagtcctttcgggacaccaacggggatggttttggagacatccccggagtgattgaaaaattggattatctgcaggaattgggggtggattacctgtggctgacaccgttttttccatccccccaacatgataatgggtatgatgtggcggattactgcgcagttgatcccaagtttgggacgatggaggatttggaagagctgatccggcagagcgaggcaagaggaatgggactgatgctcgacatggtattcaatcatacctccactgaacacacatggtttcagcaggctctggcaggggatgagacctatcagaagtattatatattcaaggacggcaggccggaccgcattcccacaaactggcagtcaaaattcggcggcccggcttgggaatatgtacccgcccttaaaaaatggtatctccggttatacgatgtgacccaggcggatttaaactgggataaccccagggtccgcgaagaattaaaggagattctgcggttctggaaaaacaaaggcataaaggcgttccgttttgacgtgatcaatctggtttccaagccggaggtgatggaggatgatttcctgggagacggacggagattttacagcgacggcccccatattcatgagtatctgaaggaactggtgcgggatgcggggattgaggatttcgtgacggtgggcgagatgtcttccacgtcggtcgaacactgtatccggtattctgcgccggaggaaaaggaactctccatgtgctttaatttccaccatctgaaagtggattacaaggacggggataaatgggcgctgatgcctgcggattatcagaagttgaaagagctctttattgagtggcagatacagatgcagaaagggcacggctggaacgcgctgttctggtgtaaccacgatcaaccccggattgtaagcagactgggagatgaaacggcctattggaagcagtcggcgaaaatgttggcaggtttgattcatttgatgcgcggaaccccctatatttatcagggggaagaaattggaatgctgaacgcccattatccttccatcgaacaataccgggatgtggaaagcctgaattattatcagattttgttgaaaaatggaaagacagagaaagaggcgctggagacgttggcggccagatcgcgggacaacagccggacgcccatgcagtggaatggggaacggtacggcgggttttccgaggtggaaccgtggctccccatgtccgctggattcagaaacgaaattacggtcgaagcccagcaaaacgaccaggattccattctatctttttataagaagctgattgccatgcgaaaaatgtatccggtcattgcagagggagaaatctcctttttagagaccggaacggaccgggtgctggcgtaccagagaaaacttggggagcagcagatcgtcgtgttctgcaatctggacggagagaagcatacggttaaggcggacggagcctggcgcggcgatccggtcttgctggaaaactatgaagcccgtcaaatggacccggaaggggaaacgtatacaatggaaccctacgagtttatggttcttggaaaggtataaagaacataaccgctcatcacaaccggctgccgtcccgttgtggtaagcggttatttgcgctgatacctctccgccacgctgttatcgttcccccacgctcaacgcctcaaccgccacgctaccgccccgcacaacctccacccggttgggatagcatttttccatcaaagcgatcagctcctgattgcgtgcttccgtctgcacgctctcaatcaataccgttgccgtggcataatcgatgaccgacacgtgaaagatccgggaaatgcgaaacagctcgtcgatatcccggtcggagcagtgattgactctcacgaacatcaattccttcatgtggatcggtatgtcggtataatccacgaccttgatgacttccacgctccggcccagctgcttttttacctgttcaaaggttttgtcgtcgctggtcaggctgatggtcatccgggaaacggtattatcttccgtcacgccgacggtcaggctgtccagattgtaggacttcccggaaaataatcccgaaattctggcgagcacgccgatctcattttcgacgaataaacagagccatctttttttcatatcagttatccccgctttccaaaatcatatggtcgagagcgttgcccggcggaacaatgggcagaacgttggcttcccgctcaatgagaaactcaatgaccgtcggcacctttggcgtaccttttgccgctgttaacgcagccgcaatttccgtttcggaagtgacgcggattccgtttgcgccataactttccgccaattttataaaatccggcgtgtattccgggcagtggtccgccggagaattacagtccggggggcagctcctgcgacggcgcatacaggtgccggaatagcgcttattgaaaaacatttcctgccactgccgtacatttcccagataaccgttgtttaagatgcagatgatgagaggcagtccgcagcagacggcggtggccatctcctgtatgttcatctgcatgccgccgtcgccggtaatcacgatcacatccctgtcgggatttccgattttagcccctatggcggccgggaacccgtagcccatggttcctaatccgccggaggtgagcagctgtctgttcttgccaagttccagaaactgcgtggcccacaactggttttgtcctacgtccgtggcgataatgacgttgtcaaaggtatcgttaatggcgtttatgattttttgcggcgtcagtccctccggtcccatggatatggggtgctgctttttccagacgtttatttcctccagccattccccggtgccgcctggctgtgccttttccagcagcgctgagatcgcgcttttggcgtcggccacaatgggaatatctaccgcgatatttcttgaaatggaggcagggtctatgtcgatgtggatgatcgccgcattgggggcaaattcaccgattttgcctgttatccggtcgttaaaccgggtcccgatggaaaacagaacgtcgcagtggctgatcgccgtgttcgccgcgtagctcccgtgtattccgatatttccaatgtagaggtcgtgggttgtgggaatggccccctttcccataatggtggtaatgacgggaacgcccgtggcttcggccagccgctgcatttcatcctgggcgcggcttatgatgacgcccccgccaatgaggaacacgggctttttggcgcgattcaatacttccacggcttttttgatctgccctgcatggacggagcccttaggtttatagcctctgatctccacttcttccgggtattcgtcacttccgtacgcctgctggatatccttgggcaggtcaatcaccacaacgcccggctttcccgttcgggcaatataaaaggcttttttgatggtctccgccaaatcatcgcgtttgcggaccgtgaccgcatatttacagatgtttctcgtgattcccacaatgtccacctcctgaaatgcgtcgttgccgatcagtccggtggggacttgccctgtaaaacagaccaggggaacgctgtcgtaattggccgtggcgattcccgtcaccagatttgtggcccccggcccgctcgtgaccagacagacgccggtttttccggtggaacgcgcgtaaccgtccgcggcgtggactaacccctgttcgtggcgcggcagaatcacgtcgatgtcccgctcgccgtaaagggcgttaaaaaggtcgattgcctggcctcccggataagcgaacagcgtatccacctgttccgctttcagtgcttttacaaataattctgctcctgttatcaatcgaatccgcctccttgtatgcgtgtgcttgcttgcatttgctgcttataaaatggtactggaagtacagtaccatggtttaacgctcagaaatcccgatctgaaattccgtttagaaataccgccacgctgtttttgataaactgttcccggtcaaggcccgtaagctcctgattgaaagaggacttcaaaaacgtgtagccgaatgtggatgagaaaatggtcattgccaggctttcaaagtccatatggcgtattttccctaattgctccattttttcaaaatattcaatcaaagaggaaataaaggcctggggcactttcatgatcagaggggcggtttcatcatagagctggggcgccctgagtccgatggacaggtttacaaagtccggggtgatccggtccatatatgcggtcataaacatttccaaatcgggcccaagctcccagactacattttgaaatagctccggggtaatattcgcgcgccatttttcctgtgcgacgccgtttaacacgatatcctttttgtttttgaatttccggaacaacgtgcattcattcacgccggccagatgtgcaatgtcctttgtggtcgttgcaacatagcctttgtcgcggattaatgccattgtcgcgtcgatgattttctggctggtatcgtccatattgacctccatgcaagtgcttgctatcattttagacgtttaggaggagtttgtcaagagccgattgactgcaggaatcatgcagcggaattgggggccgggcggaagctggagatggcttgctgtgtgcggtgcttgtggctttagtggtttggagatataatgattaagcggtgcattttgccgtttgggccgtggaaatcaaactttggaggtcttgtattacatggattttatcaacttgctgccggcgggagatcgtgatgaattgcgggaatggcttatggagaatcatgataaagaaaatgaatgctgggtggttgtgaggcggggccgtccaacggatgacgaaacattttggtatatcgatgcggtggaagaagccttgtgttttggctggatcgacggtaccacgaagaaaatggaaaatggagtcacggctcagagactggccccgcgcagaaagagaagtttgtggtctgaattaaataaagagcgctgccgcagaatggagcgtttgggaaaaatgacgcagaagtgtgggagaactttttgaaatttcccgttttataccagcgggtacggatcgatacgatacagattaaaaagaagcaacctcaattatttcaggcccggctggataaattgatcgagaatactaaaaagggaattatgtacggggagtggaacgacaatgggcggctgttggaggaaagcgggcggaggcagcttttcggggtatcggatccggcgtgcgaatatcctgatttggagtattcctagcacatatggatggcagcccaaaaacgattgcctgccattggcgcccggacgaatccccggggagcagcagttccccggggattctgtttttcattcagaagagtagattttgccgtccggtcctgttttacaacacctgcacccgaaacgcggccgactgcggcggaatgctgagcgtctccgcattggaatgggtgattcggaccatctggccggggcggaggtcgccgaagcggatcggagctccgaagcggttggtaaacaccgtcgcgttggagatgttgaaccgggtctgatcgttgggattgttggcgcttcccagcaaaatatagcggttgttgaaatcaatccgggcgattctgcctgtggtcacggaggaggggcgctggggcggcgtgggccgcaccggaggtctggggggaaggggcctgggcggaattggctgcaccggaggtctgggcggcagcggcgctaccggaggccagggccgcacgggcggcagaggctgtaccggaggccagggctgcacgggcggcagcggctgaatcgggggaaccggctgcaccggcggaaccgggacctggggcgtcctctggatcgcaacccagaaggcgttggactgaggcgggatgcttcgggtcatggcgggagagaagcccacgttaacccacatccctttacggatgcagcatatgcaggagttttgtcccgctgcattggttaccgttgtctgacggttgagatttaatctgatttgctgtatggacacagcctgccccggttcccgcacagcgtaggagaccaggatactgcccgatgaattattggaacaggagacatcttccacataggcgttgttgatgcgcataatatccccttgctggaacatggtgccacgaggatcattgttcatgagaaataccaccgatagtagttttactgtagtatatgcggtgttttaaatggagtgagaatacctctcccggaaatgcggcggcggtgagccggtttggcggcccgggccaccctgtccgcccggctactccgtccacccgggtcacctcgggggcctcggaccaccccgtccgccccgggccacccaacccgacaaatccgcccgcctccgtcaggcgtgtcgggccgccgcgccgtaccgccgtgccgcctcgctctgcaaccgacaaataaaacctgaattgaagccgagaattcatctaaactatggtaaactaaaatcagcacgctgtcacaggacggcaggagaaggaggggattcgtttatgaattatgtctgtgcggatattcacggaagatgggataaatatcaggcgatgctggaggatttgaacctgggggaggacgacaagctctatattcttggggatgtgatcgaccggggagaggacggaatccgcattttgcaggatatcatgggccgtgagaatattttcctttttattggaaatcatgaactgtttttgtactgctgcatacagtgcggggacgagggatggaccgagagctggatgtcaaacggcggaaggcccacggcccagcgctttttggcgctggaggacagggagcaggacgcaattttgaaattgatagcggattcttatgttgccattccggatctctgtgtgggggggaagcattattacctggtgcacgcttacccgaatctgcgctatacggaccggccggtgcgtgtgagggacatgggggaggatgagttggagctgctgtacgacatggtttggcggcgggcctcggatgaacagtggaagggagaccggaccctgagagcggtctgggaaatggggcgaagggtgttgatcgggcacaccatcaccacgtacttttgcagcgccagctgcgacaaaagcggccgtgccagaatctttcgggataagtattttacctgcctggactgcggctgcgccataagcggagaccgggcctgcctgggtgtcctgcggctggaggatgagaaggagttttactattaagacggattaaaaaatgggagagcgcccggggcgctctcccatcacgattttatccggcgttctccgccgcgaactggctgttgtacagcgcggcgtaatagccgcccttggccagcagttccttgtggtttccaacttccttgatgtccccgtgctccatgtagacgatcagctgcgcgtccttgatggtggataagcggtgggcgatgacaaagctggtcctgccttccatgagcttgttcatggccttttggatcgccacctcggttctggtgtccacggaggaggtggcctcgtcgagaatcaggatttccggatccgacaggaaggcccgggcgatggtcagaagctgccgttgtccctgggcgatgttggaagcgccctcgtggagctgcatgtcgtagccgccgggcatggacatgataaatccgtgggcgtgggcggccttggcggcctgcaccacctcctcgtcgctggcatcgagcttaccgtagcggatattgtcccggatggtgccggagaacagccaggtgtcctgcaataccatgccgatcatggagcggagggattcgcggttcatgtcccgcacgtcgacgccgtctatggtgatgcttcctccctttacgtcgtaaaaacgaagaatcagattgaccagcgtggttttaccggctccggtggggcccacaatggcaattttgtctccggagcccacatggagatccaggtcgtggatcaacagccggtcatcggagtatccgaactgcacgtggttgaagtccacatttccctcaggctttttggggaattgctgggcctggacctcgggcacctcctccttcgcatccaggaattcaaagactctctgagccgccgccatggtcgcctgcatgatattggcgatgttggagatctggttgatgggctgggaaaactggcgcagatactggataaaggactggatcatgccgatggtcagcctgccgtttatgcagagccatccgctgactaccgccactcccacatagccgatgttggtcagcgcctgggtcagcggcatgatgatgctggatgagaactgcgcccgccagccgttggtgtagagccgctcgttgatatcctcaaaatttgtgatgatatcctcctccttgccgaaggcggcgatgacgttctggccgttgtacatttcctccacatacccggtgagttcacccagggcggactgctgtccctggaaatatttctgggaatgttttacaaccttcatgctcacaaatccgcagagcgggatcacgcagacgccgatcagggtcagaatggggctgaccaccagcatcatcacgaaaatgaagatcatggtgcacacggccgtgatcacctggctgatgctctgctggagggaggtgtcgatggtgtccacatcgttggtgacacggcttaacacatcgccgaaggtatttccgtcaaagtaagccaggggcagacggcggatctttttgtccaccgccatgcgcaggtcgtgcatggtgcgctccgccacgccggccacgataaactgtccggagtagttgaacagaaaggccagcaaatagacgcagcccagctgcagcagcacggtgagaaacgccccaaagccctggagtgtcccggttttgtccactgccaccgccaccagggcgtccatggcccggccaagggtataggggccctgggtcgtaaacacggcgcccagaaccagacaggcgaccatgaggacgatccgcccacggtagggtttcataaaggaaaacagacggcgcatggtgcctttggtgttgatcggtttcgccgtttttccgacatttgtgtatttcatgcgctcatctcctcctccgataactggcttcggacaatttcccggtaggtctcgcaggtctttagcagctccctgtgggtgcccatacccatgaccttgccctcatccatcacgataatccggtccgcgttcatgatggtgctgacgcgctgggcgacgatcaccaccgtggccgccccggtttccgctgccagagcctggcgcagcgcagagtccgtcttgaaatccagggcggaaaagctgtcgtcgaacacatagatctcgggctttcggacgatggccctggcgatggccaggcgctgccgctgaccgccggagacgttgctgccgccctgggcgatctgcgagtcaaacccatcgggcttatcctcgataaaatccgtggactgggcgatggcggccgcctcccgcacccgctcgtcgtttgccgagtcgtctccgaactgtatattttccgcaatcgttcccttgaacagcagggccttctggggcacgtagccgatttttcttcgcaggtccttcagatcgtaatccttgacattcactccgtccaccaggacctcgccctcctgcacgtcgtaaaaacgcgggatcagtcccaccagggccgttttaccgctgccggtgctgccgatgacggctgtggtttccccgggtttcgcctcaaaacttacatggctgaccgcaggttcttttgctccggggaaataaaagctgacgtcgcggaaggtcaggcagcccttctgaccggcggactgcctgggctgctccggatttttaatggaattgtccgtgtccagcacctggcagatccggtccgcggaggcggcgcatctggggtacatgacaaagatcatggagagcatggtcaccgacatcatgatctgcatgacatactggataatggccagaatatcaccgggcatcaccggctcggtgcggattccctgcccggcccgccagagcagtccgactacggtcaggttcaataccaggatcagggacggccctaaaagcgacattgcgtgcatcattttcacggcgttgttcatcaggtccttgttggctgtgtcaaagcgtttttcctcgtagtcctcggtgccgaaggcgcggatcacgcggattccggagagcttttcccgtatgatcagattgatccggtcgatcttggactgcattttccgggagaggggcatggcccggcggccgatcaggctgataataaagatcatcaccggcatggacaccaccaggatgctggacattttgggattcttgctgtaggccagcaggatgcccaccacgcacatgatcggagcggtcagaatgatccgcaggaacatgaccataaagttctgtacctgggtgatgtcgttgttggtgcgcgtgatcagcgaggcggtggaaaatgtgtcgatctccgcctgagaaaaatactccacctttttgaacaccttacttcttacattttttcccagaccaagggcgatcctggaagcaaaaaagccggtggtgatgttgcacaccattccgagaatcgcgatccccagcatgatcagtccggtgtgaaggatatagttcatatcctttccggcgatccccttgttgacgatgtccgacaggtaggtgggaagccccagcgtggcccccacgcccgccgccacgctgacgaacacgcacagcagctgcaggcggaacattttcagctccgcaaatattttcttcatgttttacctccttggttttgcgaatacaagcgccggaaggtaacgccgccggcccattgcatttaataaaaatcttccggaaaagcagttcagctttgcagataccgttccagacattttaacccatttaaaatctgttccaggtcctccgggcttatgacgtcctgctccgggtgtctttccatttgccgggccatgcgctcgatcagggttcgtccgctttccgtgagcgccacgtcgataaaacgggcgtcccggtcatttttggacatggtaatgtgtccggctttttccagcctccggcagaacatggaacagttccccttggtcacgtgcaggctttggctgagctgagtcaaattgaccgtttttccggccgtgaacaggtagttgagaactcttccctgctccggggtgatgccgaagggacggcatttttcctccacacgctcccgaaccagccagttcaccttgcgcagctcctgaaaccattggtccttaaaattgatgtatgccatctgaaaaacccccttgattttccggttaggcggatgccctgataaatagtttatgtgtaaactgttatagaataccattggggacgcggaaaataaagtctaattttcttaaaagattctaaaaatttggtaaattgcagcccgaggacagacaggagagcgtctgtgtgcggcccatggaatcccgtttcgggcaggggaaaatacagattgcccattgcatgggcgcacagtataatggggatatgaggcttggaatgcaggaggaaaacgttatgggtttatttggaaaaaagagcttttttccttatgtgggggagatcggaaacgatgtgatggaggagattcgcgggacggttgcgcgcgcccagaggatacttgggctctccgatgggaccggcgggagagagacggcggctgcgatcaatgaaacggtggaccgcattctggagaacggcgggctgccggagggattcgtggatctggaggatgcggccgtgtgcctgggggtgctgttcggacatgcactttgcgtggggcagcagtggaaatggaaggcgcttggggaaaacgccgggaacgcttcgttttgtgtcgtctcgcccagggataatttcagcaacgcgccgatgccctatttgctgcggattctctcaggaaacaaccggaacgtggatggaaccaacgacaataccgtgctgctgctctacaatatgctggagaatatcgaccggaagccggaaaagcagaaatattttcccgtggcgtgagcttatggccggagtcaggctgcgcggctgccggtgagggaccagagggtggctgcctttttccaaggtccttcccgccggatccggtttgacaggcgctcggacatggccaccgtggtgagggtgacaaaaatttccagcgcgctgctgatgatcccggccattgccagcaggaccagggatataaccaggattaaggccagacctgccaggtacgggcggtacgggccgggacttaaccggtaacggacccagaccaccgcggccaggtaaatcagcagcagtacggtggacacaaaggcgaaaacgatgtgcaggaaggattttaggggcatctcatccggcaggtagggcgttgtgatggcgcagaacaacagggccagggcggcggggatgagctgggagaacagggggcgaaggcgcaccaggggccgcagccgccggtagatcagataaaagtacagacccacgacgattccccagatcaggaatgccagctttttgtccatgagattgccgattacggaaaagttggtggtaaaccagttgtagcccccggtgaaggcgatggtgtagaccggaataatcaggtaagccagaacctttatcgtcataatatcatcctttgcatcaaaatacagtcagtataacagacagttgaaaacagaggttaaaaaaagcctgatatttttataaagtattgataaacagaaattttaggaagcggaagaaaacaggcgtcggaggaattggcggctttgccggctgaattttacatttttgcagaaaaaagcaaagttgggtgaacgttagacagcggatattgcctgctttgacaaaaaagcggggtttcgaaccggaaaaatttcctccggtgtgttacattataaaaaaagcgtttcggcgtttcaataactgtgcgggaggaacgagatgatatttgtcacaggggattgccacggggattaccggaaattgagcagcaccgcgtttcgggagcagaaagaaatggaccggcaggattttgtgatcgtgtgcggcgacttcggctattgggaccggtccagacaggaggagtattggatggactggctggcccggaaggattttacgctgctgtttgtggacggcaaccatgaaaattacgatctgctggccgagtttccggtgcagatgtggcacggaggcaaggtgcagatgatccgggaaaatgtgatccatctcatgcggggccagatgtttaacctccagggccgcaggttctttaccttcggcggcgccaggagccatgatattgtggatgggattctggaaccggacgatcctgagctgcgggacaaggtgaagcggctggagggggcgggcgcgctgtaccggatcaaccacctgacctggtggaaggaggaaatgccctcaaagcaggaatatgaggaagggcgcagctgcctggcgcagaacgggtggaaatgcgactacatcctgtcccactgcgccccttccagcgtccaggcccagctctcctgcggcaggttcgacacggacccgctgaccgtctatctggaagagatcaaagaacgctgcgaataccggaaatggttcttcgggcattaccatgaggacgagctggtggacgaccggcatatggtgctgtaccacaggattgagcgggtggtttaaggcggaaactggcggcggccgggatgtggaagattgggcggggactgttggatgaacatgggaggatacgaaaagtataaaaatatcaaaatggtttacaattatacgaataaaatgttaactaaactattctaaaaatataaaaaaagtcaagttatacttcccttatcaagacatttatgctacaatcaaatcagggaaatcaattcaggcaggttcccaaagtcggagcctgccgtttttaacgaggaggaacaatcatgggaaaagcggatgagaatatgagcgaggagaattaccggactgcgctggatttgtaccgggagtaccgggggatgaatattacagagttggccaatgcctctggggtgtcccgccagaccgtaggttcggcctgtaaaggcgaactgaagctgggagaaaagcgcctgcggatgctggcaaatgcgctgtgcgtggacccggatgatctggatcaggacctggatcccctggaggtgcaggacaaggtggtcaacattccggcggagctgcaacgcttttcggacaaaatcgcccgctgcaagcccaaggatatcaggcggaagatggacaatgtgatcgcctacctggatgacaacgacgaggacgtgcacaacgttatgacctatcttttgacggcggccaattccctgggaaaagttctgaccggccatctggtggcgaagctttatccgcacgcctactattttaagggatacaggcccaagattgacgtaggttactatgcggtggacgagtcccccggggagtaccaggcatttgtcctctttgaggattgggtctacgatatcttcggactggagaatcctcttcaggaatttgaggtgccaagctttgacggcagcggtaccgtaaagcagaaaagcctggattttgccatccccattgagtatcacgaagacggggacatggattttgagtccgagcttttgaatcagatcgtggattatatgtgggagtatgaggcttgcgacatccgcaatcccaaattagtgtttttgtttgaagatctgctggacgatatgttctcctacgccacgatccaggagtatgtctgcgaggaatacgatcccctgctcccctacaagacgaaaaagcgggaggagaaatatacgcagcttctgtataagattttgcaggaggaggggagtatggacaaggcggtgcaaaagaccgcgaagattctcagcgagataaacacgccggagggggaggaggaaaaggtatttgagcggtacggcctgaacgacaaggtgtaagggggcggatttagaggtccccgtctatatacaggagtcggattgaggcgccccagcctatatgttgggagagcggacggagattcacctgcctgtggccggagcccggattgacatttgttcatatatacgtcgcatgacgaaaaagccccgccgcccgcgcctcaaaagccgccattttcaaccccggccgcatttgcgcgcagcgcgcctggtctgttatattgggggcaggaggtgaaaattgtggataacgcgcagagggaattgagagaatggctgtgccgtggccgggaaacggacggggaacagaagctctgcctggagattgccggcgaggcgcaggcggaggggaacaaggaacgccgggtggtcctgcggttgagcgcaaagggaattcccgtctatgagatggaacaggaaatcccggcgggagagcgcccggatgagatgcggatgtggcggcgtctgacccagtcgctggcccgggactgggaactgccccgggaaggggcagagcgtttgttgaacgcggatttttatttctaggacagtggaaacgataggcgggctgatcgcggcagggacgcggggcccgctttttccggccgggtgtgcaggcccgggagtgactggggaggttggcctggtttacaccggcgcgcccccatccaaaaccaccacctcccggcactggttcaatttgcccaaacgcttcagacatccgttcactgcgttctccagctttttcgtccgcctcacgccctcctcataccagatgtttttgacaatcagcctgccggttttggcctcggacaccgcctccacccgtccggcgaagcggccgccccagatcatgggcagcacgtaatggccgtatttgcgtttggcggccggggtgtaaatctcccaggtgtagtcgaagccgaacagggcgcggatcaggttgcggtcccacatcatgcagtccaaaggcgcgatcagctcgcatcgcggtttgtaggcttcgccctggcggacccggtccataaggggcagatccccggcgcggcagtataaaagatgcttgattgtgtccaccgatacctccagaatctccccgccgtccagcagctcctcaaaagcccggctgcgctggggcgttttgagtccccagctgttgagccacgcgtcgctggggcggttccagagaaggcccaccgcgccgatgcgccgtctgatgcgccacttcaaatgcgcctcatccccgggcatagggtccggcgcgttcaaaagcgccgcgggcagatggcgttcggccagatcatagtattttctggcccccttcttgtggtggatgattagctcgccggtagagtagagctgctccagcgccgcccgcgcggcgtttgtctcaccgtcccagctcccgctccagtggatacaggaatgccagcggatcgtgcccggtatgggcagttcgtcggagctgacggggccgttttcccggatataagccagggcctggtcctccaacgcggccattccgggaaaacgccgaccgttctcacgggcagccctgcggtaacgctcaaaatagggccagtcctccgccgggatgatggaaatgttcttgtcgggataatccacgagactgcggtcttcatacaaaagttcatagagcgtctgcttggtaaagtccttgacccgggactggagcgtcagctccgcgtttttgccgcaggcgtccaccgggtcgaactggatacatcccgcctggcgtacatagtccagggcgccctgcttgccggtgaaccggtattccccaagcagcccttgttttagcaggataaaatttctcgcttcttcgatcgtcaatggtatcatatttggtctccgcggccgccttcagggctgtgactccggccccaccggatcatggccaggatttcctcctcgctttccgtctggtcgtagtctcccgtcagctggccttcataatgataaaggatgtggttttcctggtttcgccgcaggcagcggatcagctccttcgggccctgtttacgggcgaaccggacaaaggcccgggctcttgctttggaaagcatgccgctgcggcatgaaaaatgatcgcattcccaacagccgttcaaaccctgttcgcggcagcagcggtagttttcgcaccaggaatggatgtcgcagccccctgcctgacagccgggacacgcctcattgtgggaacagaggcagcaggccaggccgcagtaggcgattcctttttctgttttagggctgttatgcgtgtttttttccatatcgatatcctccgtttctttcagcataccgcaggatatacgacaactgcctgtcataattggccgtacagggaacaaatttttttggccgtccggattacccgctcccgaatccgttccggttccagaatttcgatttcatctcccagggccaggagagtgccgaaccagaggtgttcattttcaatgacgctcagtttcatctcgcattccccatcttccagctcccggaggacggtcccgttcaggtattcaatggcccttgatctggcggtggggcggcagcggatggtgacggttgtgtgcgccagtggggaatggcggtcatgttcccgcaggatggtttcagccggtgcgtgttccatggtaaaggggagtccggtgatttccgcctgctccatccgtaccagcttgtaggtccggtaatcctcccggaccgtggagtaagccaggagataccaggcgtaccagcggtagaccagagccaccggttccactgtgtggacacgggtcatattgtccgcattggtgtaggtgaagcggacgcagcatttccggcggatggcggtttgaagctgttttataagagtttcgccgccttcccgcagtacggaaaaatccaggataatccgctcgttgtccggttttgagagggcggtaaatttttccagcgccgatgcgatattggggctgggcatggcggaggaaaagccttttagggcggtgaaaatcaggccgtaatcctcctgggttatggcctggctatccatgcggaaggtgtcggggatggaatagcccccctttgcgccggattccgcggccaccgggatgcccgcctgacagagtgcgtcgatgtcccgctgcacggtgcgcacggaaacttcaaatttccgcgcaagctcagacgcggaggcttttttgtggttcagcagatatacggtgataccatacagacggtcaattttcatggcgctttgctcctgggggaatcgggggtggtaaaggagtagccgggaaaatggacgcgcggcgaaggcagagattaagaaggattgaacctctgcgcccaggccgcggctcccttgtgtctatggtatcacgaatcgggacaatatgaaatatgaaatgtctgtgagtgcaggccaggtacagattaatgtgagccggtactggtaatagccggttttaaggtacttcagaaattgccgcctaaacccgacaaaatccccctgatttggaaagttccatcccttcccctcgccctttccacaactccacgccacattaccgttttggcgcacctgttcaggcgggtctggtttgctatactgaatataggatacctgaccatgcgcagcaacagattcagaagagaggagaatggcgatggatgagaacaatcggaaagaactggtacattggcgggtataccccgcagaggacgaggagacgggtgcagtgagcctgcggatatggggaagaggcgaggggttcgacgtggccgccgttccaatccgggcggtagcgccggtgccgggtggattcgaggcggaggcggaggatgggaccatttttctgctgtttttgaacgagaatgcctggcccacggtgttcgggctggaaaaaacggagtggtaccgcctggttcataggctggattcctttgatctgaaatgctttgcctgtatctggatggatgatttatatctgtgctcagaggagaaataccagcgtgagcaatgcgaggaatgggccggaagaaacggcctggacccaggcgcgtgggagcgcattcgggcggtgaggatggcgattgacgaaaaacgggagccgcggccttccggtttggaaccgtgggatgaggagaatgcgctgcgcatcgatctgagcgcgttttgccggaactactactgcgacttccgggagggaaaaaacaaggcagattatcagcgctgggagtatccttcacagcgtctggaacccggcaaggaacctttggtgacggtctgcctgaaatggacggacgatgattcgcccaaaggcacggtattccggctgcgataccgcatccgcggggtgaattgtctggagatactggaggcgaacatgttcccgtgggtcggattgcagtgggtgcacagtgtggatgaggagaaacttgaacatacccacttccatttccggctttgggaacatgtctacctgtgcaatgtgggggagacgcctctttggctgaccggggcgttttccggggaatcgttaaagccgggtgagatgcgggagctggaagtggctttttgcgcctgacggacagggcatgaggtggaaaaaaggaggttggaatgagacacggcgagtcgtattattactatttggagggagtggaggaggttcctgtttcggagcttctgggcaagacggtgaccagtctggaggtgtggggaaacatggaggaactgcgctttttctgctccgatcacacggtctatttcatgtatcatgagcagggatgctgcgagtcggtacagatcgaggacatctgcggcgagctggaatatctgctggacagcccgattttaatggccgaggaggtggccggggagagtggcatgaacgaggatagcctgacccactatacctggaccttctataaatttgccacctgtaagggatatgtcaccctcagatggctgggcaccagcaacggctattacggcgaggaggtttccctgatccgggttccgccggaaaacctgacaaaggaagggctgatacgggagacgcttctggaatacgagccggacgggaatcgggacacgatccggtgcaggatcgatcctgaagagtacggcagataccataccgagatggatttgcccgcctgggtggaaccgtatgggcttcccgttaagattgtggtatcaatcgatgctgcgcttatggaaggctttcagaccctgaatccggaggaacgggtcaggaaatatctggagaatgtgtatctgccccaggcggccggtatcgtgattgaggacggccggctgcgggaggaattaataaagcgcctgtcggagtgcagctggaagacgagaatacggcagctgtgatgggaaaaagattgtgagaatcggaatatggaaaacggccccgccgggtgtgcagcgtaagctgcccggcggggccgttggcttggagacggaaaaattgcgggcggtccgtctatttttttccgctccagcagtaagtgcacagcttgcagtccggcagtccgatggactccaccaggtcgtccagacggtggaatcgcagggtggtgaagttcagccgccggcggatttcctccaccatctcgcagtaatttttgctgtccgggttggcgtaatccagcagcacctcgtcggatacgttatccccctcccggtcccggataatccgccgggtgattaaatccagctccgaggaggagcgggaaaagtttaagtagcggcagccgaacatgatgggcgggcaggccgggcggatgtgcacctccttcgcgccgctctggtacaggaattccgtggtttcgcccaactgggtgccccgcacgatggaatcgtcgatgagcagcaggctcttattgcggatcagcgcgtccacagggatcagcttcatccgggcgatcaggttgcgctggccctggctggtgggcatgaaggacctgggccaggtgggggtatatttgatgaaggggcgggcgaaggggattttcgactcgttagcgtagcccaccgcgtgggcgatgccggagtccgggacgccggccacaacgtcggggcggacgtcattttcctgatcccggcgggccaggagccgtccgcactggtagcgcatctgctccacgttgatcccctcgtaggaggaggtgggatagccgtagtagacccagaggaaggcgcagattttcatctcctccctgggaggactgagtatttccacgcgctccggcgtgatgaaatcgatctcgcccgggcccagctccttaaaatccgagtaacccagattgatataggcaaagctctcgaaggacacgcagtgggcgttgtccttttttccgatgacgatgggcattctgccgtagcggtcccgggaggcgtagagcccctcaggggtcaggatgaggatgctcatggagccctcgatcttttcctgggcgtacaaaattccttccaccagcgtgggcttctggttgatgatggcggccaccagctccgtggcgttgatgcggccgtgactcatttccataaaatggatatggccgttctcataggcctcggccaccagctcgtccatattgttgattttccccaccgtggtgatggcgtagctgcccagatgggactggatcagcaggggctgcggctcgttgtcggaaatgcagccgatgccaagattgccctccagctcctccaaatctccgtcaaattttgtgcggaagggcgtgttctcgatattgtggatcgagcgggtaaacccctgttccccgtatacggccatgccgcccctcttggttccaagatgggagtgatagtccacgccaaaaaacagatccagcgtacagctctgcttcgatacaactccgaatattccacccatttatgattttcctcgcttctttgttttgcggcttcataaaaacatgtcatattcatcataccatatattagtatagaaggacaatacagtttacatattatttatacttattaatatttataggaaacagttgagacggcggggaaattggcgcgaaaagccgcgtcaagcttgcttgtaagcgggttttcgagtcaattttcccatcggatggacatccgatgcttcttgaccggctttttcggtcaagaagaggagccgtctcaactggtatgtggcggggaaattggcgcgaaaagccgcgtcaagcttgcttgtaagcgggttttcgcgccaatttccccatcggatggacatccgatgcttcttgaccggctttttcggtcaagaagaggagccgtctcaactggtatgtggcgccattttccccatcggatggacatcctgtcgaaaagatcctggtcataaaccagagcctgtctcatatactgaggtaaaaggagtgaggaaggatgaaccggaaggatgagattctgaaattgtttccaaaggaattgcgcgctctgctgggacaggtcccggcggagtttgaggatatacaggagatccgcctgcgggcggggcagccggtgattctggtctgcaaaaaccgggagtacatggtggggcggggcggagaactgttggggaccgcgggggaaggagcagattccttccggcgagccccctcttcctccgtccagccctaccgggccacccgggaggagctgcgggcggcggtggactacatgagcagctattccctctacgccgcggaggaggagctgcgccagggatttatcaccgtccagggcggccaccggatcggggtggcgggcaggacggtggcggaccggcagggcgtccgcctgatgaaatttatctcctttgtcaatgtgcgggtggcccaccaggtgaagggctgtgcggacggaatcatgcggtatctgtacgcgcggcagcccggacagccgggcccgcatttctgcaacactctgatcatctcgccgccgcggtgcggaaagacaacgctgctgcgggatgtgatccggcaggtttccgccggaaacgcctttgcgccggggatgaccgtgggggtggtggacgagcggtcggagctgggggcctgctatcagggcgtcccgcaaaatgacttaggtccccgcaccgacgtgctggactgctgccccaaggatcaggggatgatgatgctggtgcgcagcatggccccacaggtggtggccgtggacgagatcggcagcgccggggacgtggaggccgtgggctatatacagagctgcggctgcgccctggccgccacggttcacggcgcgtcgctggaagatatttacagcaaaccggcccttggacagctggtggaggagggcgtgttcgagcgctacatcctgctggaaccgtccccggaaaatggacggaacctgcggattctggaccgggatgggcgggagttggcgggaaccctggggcggctccgcccggacacgccgcacccccaaaccgtttctcatccaaacgaaaggccaggtgagcgcatatgttgctaaaatatctcggcgcggccctgatcctcatttccgccccgggcctgggcatgtacctggccgggcagtggaaggagcggctgcgcttgctggaaaagctgcggcagatgatctatttcctcaaaggcgagatcacctatagccacgcgcccctggccgaagccctggagcgggtgggcaggcggggcggagggcctttgggggacatgttcgtccgggcctcggagcgcatctgcacccaggagggcgagagccttcaggaaatctggagcggggaaacctggacaatggccgcgggcgcgaagaatctgcccctgaccagggctgatctggagcagttcaccgcccttggggagcacctgggttatctggatgtggacatgcaggagcgcacgctgcttctgtatctggaacagttggatctgtccatcgaatatctgcaggcgcaccggcaggaaaaatgccgtctgtataccagccttggcgtcatgggcgggatttttctcgtcatcgtcatgtgctgacggaagttagaaggaattggaggcagtcatgggggtaaacctgatatttaaaattgcggcagtggggattctggtttccgtcatctgccaggtgttaaagcacagcggaagggaggagcaggcgtttttaaccagcctggcgggcctggtgctggtgcttttctggatggtaccgtacatatatgaactgtttgaaaccataaaaaacctgtttgcactttagaagcggcaaaccatagaggtacgttccaaagcggggcggcggagactggaaggagcggaggaatatgacggtaatagccattggagcggccggcatcgccgcggtgctgatggcggtgcagctcaagggaatgaagggggaatacgccacctatctgatcatcgcagcgggcttttttatctttttctacggaatttccaagctggaatccatcatggacacggtggagcggattcagggctacatcagggtgaacaaggtctatctggcgacgctggtcaagatgatcggcatcacctatgtggcggagtttgcctccggtatctgcaaggatgcgggctttggctcccttggcacgcagatcgagattttcggcaagctttccattttagcgatcagcacgccgattctcctggctctgttggaaaccctggaggtatttctcacatgaccgggcggagcgcaaaatgccgcaggacatgggccaggggaatcctggcggcggccctgattctgctcctttgcggcgcggggggattcccggcgcgcacttacggggcggaacagacgccaacggcccgggagcgggaggaggagcggtgggatgagctggacgccggggtggacagcgccctgggccagctggacattggggaggacctggacaggatccaggagtttctggacgccaggctgacgccggggagcgggttttccttcacctccatgatgaaatccctgctcaccggagacttgaaatccgtgctgggacaggccggcatgggcctgaagaacagtctggtgagcgaggtgcactccgccggttcgctgttagcacaggtggtggtcatcggaatggtgggggcggtgttcaccaatttttcctccgtatttaaaggagggcatatttccgacaccggctttttcgtcacctacctgctgttgttcacctgcctggccgccagtttcttcgccagcatcgagatcgcctcggacgtgctggggcaggtgctggactttgtgaagctgctgatgcccgcctattttctgaccgtagccttctccgggggcagcgtctccgcggtggccctgtacgaggccatgacggcggccgtgaccctggtccagtggctgtgctgcaatctgctgctcccggtggtgcgcatctacgtgctgctggttctggcgggccatgtggccaaggaggagatgctcagcaaactgacggagcttttggagcagtgggtgggctgggccttaaaaaccctcatgggtctggtgctggggcttcaggtgctccaggggatggtggtgccctacgcggacagcgccggtcaggccggagtgcgtaaggtcattgaaatcatcccgggcctgggccagggagccggcgcggtggcgcagatggtgctgggctccggcgtgctgatcaaaaacagcctgggcgcggccgcggtggtggtcctgttgatcatgacgctggtgcccatcgccaagctggcggtgctgatgctgttctaccagctggccgccgctgtgatgcagccggtgtgcgacaagcgggtggtttcctgcgtcagcggcgtttcctgcggccacaaattactgctgaaaattgtggtctcctccctgctgctgttcgtgatcgccatcgcaatcacctgcgcggccaccaacgtcaactattacacggtctgagtccgggaaaggagggcgcgcatgacagcggtctacgagtgggtgcgcaatatcacctattacatgatttttatcaccgtggtgggtaatcttctggccgattcgaagtatgaaaaatacctgcggttttttgccggaattatcctgattctgctggtgttaaagcccctgaccgggagcctgcggctggacgagcggatcgcatacctgtttgagtccatctcctttcagaaggaggccgacgatttcaaggagaagctgtggggcatggaggacgagcgcctgcagcgggtcatgagcacctatgaggaggcggtggcaatggatatcagaggtatggccgacaccgccggattttcggtccgcagcgtgaaggtgaccattgagacggaccgcgatagcccgctctacggccatgtgacggacctgtacatgaagctgggacggcagaaggaggaaaatgccgcgggcgggggatggaatgcggcgggcgtaagcggcggggggacagacagcggacccgcagagattcagatcgaaccccggcaaatccaggtggagccggttcaaatcggaagcggggcggccggaggaccagcggggggcggcttaggcgacccggcagctgccctcggcgacccggcagccgccgcccccggagacccggcagccgccgtccccgaggcctccccgcctctcaccgaagaggaagcagttgtggctgcggtggaacagagccagatactggcgcggacatttccggcaaatctggaagagcggacaaagatcaatgcatttattcgaaaggtggcgggatattatggacttgagacagcacatgtccaggtggaatgggaagatgactaaggagaaatggctgtttctgctgtttatcggggtggtgcttatgattctggcttttccggtgggaaagggcgggggcagcggcacggccgtcttttctaagcagaaggacagcggggcccaggtgtcggagctcaagggagcggaggacggctcggctctctccgggcagatcccctccgcctccctggcagggcagaacagcgcaggcggcgccggaggaggaagcggcggatcaggaggaaacggcggcccgggcgacggaacaggagccggggctgcggggaacggcggacaaaattccgggaacggcggagtaggaggcggcgctggcggcagcgccgcggcctccggttcggcggacagctccgaagagaacatcccggcatccgcaaagggggcgggggaatccgcctacgaggcccagatggaggcacgggtcaaggagattctgcgccatgtggacggcgttgggcaggtggatgtgatgatcgtgctcaaatcctcggaggagaaggtactgcgggtggaccgcaacagcagcgtgagcgatacaaaggagcaggactcccagggcggcaccagaagttcccagagcagccagacccaggagagcacggtgctctccgggggcggatcggggcagggcagcgtcccgtttgtggagaaagagctgcgcccggaaatctccgggatcgtcatcagcgccgcgggagggggaagtcccacggtaaaagccgaaatttctgcggcgatggaagcattatttgggcttcccccacataaaataaaagtattaaagcgggtggaataaaaggagcgttgaatatgaagaagatgaagcaagtcaaagagcatatgaaagacatcaacatgaaacgcctgttccggcggaatcagatcattattaccacgctggccgtgatgatcgcggcagccggttatctgaattacgctggaaaaaaagagctggcggacagcaatcaggtctacgaggcgggagccatggatatctcggacgaggatattctggcggagaatcaggcggtgctgaacagtcagaacggaggccagctgctggagattcccagcctggatgacccggacgacggcagcggacaggtggcccagaacggagcggacggacagctggcggcccaggacggagcgggcggcgaacagttagcccaggccggggcggacggcgagcagctggcccagggcggagcggacggacagaccaccgcgccggacggcaacggcggccagcaggcggcagatgccgacgcgcagaccgggctggagaatccgggggaggccgtgctcaccagcgggatgagcgtatccgactacatagccaatgtgcagttgaaccgggagcagattcgggccaagaacaaggagaccctgatgagcctgatcgacagcaccaccatcgacgacgccgcaaaacagcaggccattcaggacatgatcgacctgaccgaggtgtcggaaaaggaaaatgcagccgaaaccctgctcatggccaagggcttctccgatccggtggtcagcatcacaaaagacaaggtggacgtggtgatcaacgcggccagcatcacggatccccagcgcgcccagatcgaggacatcgtcaagcgcaaagcggaggtggcagcggaccagatcatcatcacgctgctgaacctggcggaataaaacggaatcggaccggaaaaatcgaattataacccaaaaactctggtttacaggacctgcccgcaggcgtaaaccagagttttttatgtgtaaaaatcacccggcgtccgttgaatttgccctggaaaaattcctcaaaaacggcccggttcctacctgcggaatccggcctcctcccgctgccgggccagaagcagttcaaaggtgccctccctggacttgtgcaggtggtcctccatggccagcgcggcattttcccaatccttttccaggcaggccgtcaggatgcggacgtgctccccgcaggtctccctcacgcgccgggccgacagggtgccggtcaaaatgcggaacctccggttctgattgtacagcagttcataattctttttcaggtaaatattgtcggcggcttccatgatccacatatgaaagtcgtcgtccgcctggaagaactgcctgccgcttatgtcgggaagggaaaagaaccggtggtacctgagaatctccggctccccgagggcatcgccgtactgcctcagggagtagggctccagcagcagtctcatctcataaaccatgcgcacgtcctttagcgtcagcggggaaaccacaatgccgcgcttgggcatgattttgataagcccctcctgctccagacgccccagcgcatcgcgcacgggggtgcggctggtgtttacctcctcgcacaggtactcttcgttgtagactgcgccgggagcgaactcgcagttgatgattttctctttgatcacgttgtatgcctgctgttttaaattgcgtgctgccatggacggcccctttccgctgataaatccctggagattgctggctttattgtatacgacggcgttggcaaaatcaagaccggagcccccgaaaatccattgtgccggataaaaataaactaatgtatacataaaattaaatcaaaaccagaaaaacaagctcgaactataaaatgaaacctaaaatatggttaaaatgcacaaatagaatctatgatttatctaaaaatcaaaaaaaattacaagctatcttgcaaataaaaatactgtgttgtatactttgaaatatacaacatgccagaatggcaaagtataaaacacaaaggagaaggaacgtatgaagaaaagagtcgtgatttttttgtcaatgttgatggcagtagggcttttggccggatgcagcgggggaagcaccgccggtgtgacgcaggccccgggggagcagaaaacagcggaaactgaagtgaaggatacaacagaacaggaaaaagaagccgctccgctgaatgcggtcagcaagggcgatatgatcggagtatccctcaccagccggtcggcggaacgctggctgcgcgacggaaataccctgaatgaggatttgacggcggccggctatcaggtggatctgcagtacgcggacagcaagcctgagatgcaggttcagcagattgaaaacatgatattgaagggctgcaaggttctgatcgtggccccggttgacaacagcgccctttcctccgtgttggccacggccaaggaaaacggaatcgtggtcatcaactacgacctgggaatcgtgggcagcagcgatatcgattatttcgttggatttgacaactcgaaagtgggaaccatgcaggctgaagccatcattgagaagctgggcttagacaaaggcgaggaaggccccttctacatcgagctggtggcgggcagcctggcagaggccaactgctacatgtattttgaaggagcgatggaagccttcaagccctacatggacgcaggcaagctggtggtaaagagcggacagacctccattgaacagtgtacggtggtggactggaagctggagcttctgaccgcaaggctggacaacctattgaccacctattattccgacggaacccttttggacgcggtgttaagcccctccgattacctttccggccccattgccaccaggctggaatccttcggttacggcagcgcggacatgcccatgccagtgatcaccggaaacgacgcaacggagtccgtctgcaagatgatcgcaacggacgaggtatacatgagcgtattcaaggacacccgccttttaagcggggcctgcctggacattattaacgcccttgcggagggcagagagccggaagtgaccgacgtttatacgccggacgtatatgagattcccaccatcttcgtgcccatggagagcatcaccaaggagaacttaaaggaggttgtggtggactccggtatctttaccgaggaacagatttttggcacaaaataaatttctgccggttcaggcgaaagggagagcggagtgtcggattatatacttgaaatgaggaatatcaccaaggaattcttcggtgtgaaagcgctggacaatgtggagttgaaggtgaagcgcggagaaatccactgcatcgttggggaaaacggagccggaaaatccacgctcatgaatatcctcagcgggacttacccctacggctcctacagcggggatattgtctacgacaatgagatatgccagttccgcaacatcaaggacagcgagggaaaggggattgtcattatccatcaggagctggcgctgatccccggcctgtcggtggcggaaaacctgtttttgggaaatgagcgccagagccatggaatcatcgactgggacaggaccaacgaggaagccaaaaagtggctggatatggtggcctttaaggaggaggccaccagactggtgaaggatgttggaatcggcgcccagcagctgattgagatcgccaaagccctggcaaaaaatgttaagcttctgatattggacgagcccacggcggcgcttccggagacggaggccaggcacctgctcaatctgttaaaggagctgcaaaagcaggggcttaccagcatcattatcacccataagctcaacgaggtctgctacgtgggggaccgggtgacgatcatccgcgacggctgcacggtgggcgggctgtcggaggaggaaaaaccgtttttggaagacatcattgtgaagggcatggtggggcgcgagatgctccaccgctacccggaacggccggatcactttgtaaagccggaagtgggctttgagatccgggagtggaacaccttccaccccacctacgcggaacagcagatcgtgaaaaatgccagcctcaaggtacacaagggggagatcgtgggactgtacggcctgatgggagccgggagaacggagatggccatgagcgtgttcggccgctcctacggccagaagacaagcggccggatcttcaaggacggcaaggagatcaaactgcggtccgtggccgcggccattcagaaaaagatcgcttacatcagcgaggaccggaaaaattacggcctggtgctgccaaaggacatccagttcaacgtgtcgctggcgggcatctcctccatcgcggaccgaatgggcgtggtggatgagaaccaggacgtggtggtggcggaggactactccaagcggctgaatatccgttccacgggcattgaccagcgggtggaaagcctctcgggcggcaatcagcagaaggtggtgctggcgaaatggattttcacccacccggacgtgctgattctggacgagcccacccggggcatcgacgtgggggccaagtatgagatttactgcattatgaaccagttggcccaggagggcaagagcgtgctcttcatttcctccgatttgtcggagatcctgggcatgtcggaccggatctatgtgatgaacgaggggaccatctgtgcggagatggatggaaagacggccacccaggaatccgtgatgcagtgtattgtggagcataataaggaggaagggatataatgcaggatataaaagcaatgctgaaaaaacgcgccaggcagaacggaatgctggttgtcgtcctggtgatcgtgctgttttttcaggtcataaccaagggggtcatcttaagacccatgaacatcgccaacctggtgatgcagaacgcctacgtgattatccttgccaccggcatgatgtgctgtatcctgaccgggggaaacgtggatttgtcggtgggttctctctgtgcgttcagcggcgcgctctgcggcctgctgatgatcggaaaggggcttaacacatggctggttctgatgatcgtgttcggagtcgccattttgatcggagtttggaacggcggctccatcgcgcggttcgccgtgccgccctacattgcgaccctggcttcccagctgatcttccggggcggcacctatatcgtgttaaagggcgtttcctacaccacttatcccccggaattcctcatgctgaccaccggatttataccggatttcttcggcggcaagacgcttcacatcaccaccatgctgttgggcatcgcggcctgcgtgatctgcgtgctgctggacgtgaagaagcgggcgagaaagcgcaaatataaactggaggtgtccggagtcccgttcttcgtgggcaagcaggcgctgatctgcggcgttattttgtggtttacctactcccttgcggcctacaagggtatgccggtggttctgatcagcgtggcgctcatcgtgttgatttacaattttattctggaaaagacggtggcaggaagaaacctgtacgcggtgtgcggaaaccgcaaagccgccaggctgtccggcatcaacgacgaccgcgtgctgttcatcgtttacctgaacatgtcggttctggccgcaatcgccggaatcgtgtttacggccagaatgaattcctgttccaccatgatcggaaacggctttgagggcgacgccatcgcggcctgcttcatcggcggagcttcgcccgccaccggaagcggaaccattttgggagcgctgatcggggcgctggtcatcggcgtgctgaataacggaatgtccattatgggcgtccagtcggacgtgcagatgtgtgtcaaggggctggtgctgatgattgcggtggtatttgaccagatgcagcgaaaaggaagataaaatcggaggtaagatcatgttgtacaaaatcagccatgacaatggctttcactattgggatgaaaaaaatgaaccggttctgcgcatcaaaccgggggacagcgtggagtttgagactaaggactgcctgtgcaatgtgctcacggagcagaagagcgagcgctacgacgtggccgtgttcgacaaggtcaatgttaacccggtaacgggcccggtgtacatcgaaggagccatgcccggggatgtgctggaggtgaccatcgaggagatccggttaaaggaccgggcgattgtgacctgccaggaaacctacgggcatgtgggggatttctttactgagaccacctacaagatcacgccgatccgcgacaacatggtggtgttcgaccggcatttgcagattccctgcgatcccatggtgggcgtgctgggagttacggccaagggccagcacatcaactccaacttaaacggcgtctggggtggaaatatggacaacaccatgatgcgtcagggcgtcaccctgtatctgcccatcgaggtggaaggggctcttgccggaaccggcgacgtgcacgcggtgatgggagacggggaaatgaactgttccgcggtggaggctcccgcctttgtgacgctgaagttcaatgtgcgtaaggatatccggatcaacgagccggtgctctgcacccagacccattttgtgaccatcgcaacccgccccacggcggacgaggccatacgggacagcacccgcgagatgttccggtacataaaagagcacaccaaactggacccggaggagatttccatgctgatgacggccatcggaaacaacgaggtgtgcgtggcctgcggcgaggacagtaagacgatgcgttttaccatgccctggtacgccctcaagacgtacggattcagcgcattttaggaacagaacattggaaagatagagggatggaggatggaatgcagaagcattagaataaacgctcccggggaggtggagatcatccggacggagattccggccccgggaaaggacgaggcgctgttaaaggtgctgtacgggggaatctgcggttcggatctgggcagctacagggggaccttcgcatattttgattaccccaggataccgggccacgagttttcggcggaaatagttgagatcgacgaggaaaatgcctacggcctgaaaaagggcatgatcgtgacctgcaacccgtattacaactgtggaaaatgctattcctgccagagaggtctggtaaactgctgcgagcacaacgaaaccctgggctgccagcgggacggggcgttcagcgattacgtggtgatgccgctggagcgcatctacgacggaaagggcctgcccgccaggaccctggcgctgatcgagccgttttgcatcagctaccacggcgtgaagcgggcggatttgaaggccggggacaaggtgctggtgatcggcgccggaaccatcggcatactggcggccatggcggccaaggagcagggcggagaggtgaccatctgcgacgtggcacaggggaagctggacctggcccgtggcttcggcctggatcagtttatcctgaatcacggcgacaaaaccttcgcggaccaggtgcgccaggccacgggggccaacggattcgacgttgtgatcgaggcggtggggctgccctccacctttgagaactgcatcgaggcggcggcgtttggcggcaagatcgtactcatcggagtgggcaaggagaatctggatttcaatttcaccatgatccagaaaaaggaactcaacattttcggctccagaaacgcgcgcaaggaggactttgaacagctcatcgagctggtccggggcggaggcgtggatctggaaaaggtggtgaccgacgagtaccccttcgaggaggcggagcgggccttccgggaattttcggaaaatgcggggaagatgttgaaggttgtgatccggtttgccggatgagattggagcagcccgtttcgcgctgctgcaaagaggaagttttaggggccgggccgcagcgccggtctgtgaaagcgggtggggcttggtatggatttaaaggatgtttttctgtttaagagcaggcagaggcggcagcgggaggaagcggaatatcaggagcggattttccacctgggacaggggcaccgggaggcggtgctgcaaaggctgaaatccctgatccgggaggaaaagacggaggcggagctgatctatctctacacctgcgtgaaggatatttacaccgccgccaggcccggggagcgggaggaagcactgggggagtggtatgaaaccacatacctgttcccggaggataaaaaacgcctcatcgctctggtgcttctggagtccggcgtctccggcccggatggtattccggaggcggaagcggtggagaaggcggcggagagctgggggtagcggcgcggagtcgctgccgcaaaggcttttggaccgcgtcgcatcatccgcaccgccgtaccctgaaatctgtagtgtaaagtaaaatcccgcaaggcggaggttgatcttacgacagcccggtcctgcgggatttttctgtccttctctaacccggccgcgcgcccccgggccctatacaggcaataaacaggattgactattgatccgctttctgctatgctgtcattgttggttagaaaaaactaacccataaaatcaatccaacagagagcaaggagaatgcagattgacatacatatggatcaacccggtgacggagcacatgtaccaggtctccacgctggaagcgtttttagagaggcacggcctgacgcgggtgcgctgccgcggggactggggagcggttgtgcgggagaaataccgaatccgggcaggcgagacggaggggacggtggtggatgcccgctgccccatggcctgtaatctggccagagagctgacgcagggttctgcgcccgaaggaataccggggaatttccacattccggacattgaacccatcctcatccactgcgccagagagatcagcgcccgggaggacttaaagggaagcccaaagctcatcaccaccccctgccgggcgctggctgaggccgggaacgcgctggagcttgcggacacgcgctttttgacctggaacgggcttatggagtccgtgggggagatcctcccgggggacccgccggaggacagccccatcccgccgggattttttgacagccttgggctggagatgaacagccttacgggccgcggccctatcgaggcgtacatccgtgcagggggccgggacaaggcgcggctggcggagcttttgtactgtgaaaatggctgccacaatggagacggggtggtaagaaatgggtgacagatggaagaaaatagcggctccggccctggggatcaccgttctgctggttctctggtacgccgtgtgccgggcgggtattttcagcgcctacgttttgcctccgccggccaaggtcctgaacagctttttcaggatgctgaaaaccggcgagctgtggcaggacgtgtggatcagctttctccgggtgatgaagggattttccatcgcctttgtgctggcgtttctgctgggcatggtccgggctcttctgccgtctgcggagggatattacgagtatgtggtccagtttttccgcaacgtgccgccgttaagtatgattcccctgctgatcctctggtgcggaatcggggagaccaccaagacggtgattatcgtgctggcctcatttttccccatgtatttaaacattgtcaagggatttaccggctgtgaccggaagctgttggaggttggggatatgttcggttactcccggacccgcaaattcatacggattgtgcttccctacgcggcggccgacattctggtggggatgcggatcggtttgggctacagctggcgggcgatcatcggcgccgagatggtggccgcgtccaccgggcttgggcacatgatcctgttcgcccagcagatgtccaggaccgacaaggtgatcgtgggcattctggtgatcggcgcggtagggtatgggacggaccgcgtgttcggtctggtcatcggcaaattactgaaaggacgctgtgacaatggctggaattgagctcataaacgtacacaaacaataccgggtggaggaccgcgcggtcccggtgctgcgcggcatcggccttcagattccggagcggcagatcaccgtgattctgggccgcagcggctgcgggaaaaccacgctgctgcgcctgaccggcggcctggaggaggcggacgcaggggagatccgttacgaaggcccccaccgcaccgctttcgtgttccaggagcccaggctgatgccgtggctgaccgtgtggggaaatgtgatcttcggcctggagaagcgggagatcagccggaaaaaggtggaggacattatcgccaccgtggggctgaccggatttgagaaggcttatccgtcccagctctccggcggaatgcagcagcggaccgccatcgcccgcgccctggcctaccagccgtcctttatcatgatggacgagccgtttgcggccctggactattttaccagggagcagatgcagcgggagcttttgcgggtgcagcaaaagcagggcagcagcatcctgtttgtgacccacagcatcgacgaggcgctgattctgggccaccggatcgtggtgattgagaacgggctggtaaaggcccaataccaggtgccggaatccgccggagaccggaacctgctggacgacacgtttatttccctgaaacgggatattataaaaagcctgtagttctgtgggcgttcgcggccgcaggattcacataagaatttaaggaggattaaattatgaaaaaaatggttgcaatgggactggcggtctgcatgggggtcatgtccctttccggctgcgcgggcggaagtaaaaacgctgccgccgggggagaacagactgcggcggagcagactgtgacgggagagaacggagcagaccagggcggagcgggccaggccgggtcaggccagagcggagcggagcaggccgggtcagaccaggccggagcgcagaaggccgcttccggcttggacaagctggtgttcacctacgtgacctcgcccttaaacgtgcccaccatcatcgagcgtaaccagaatattttcgcggaggacttcgggaaaatggggatttctgtggagtacgcggagatcaattccggggcagaccagacccaggcgctggcttccggcgacgtgcaggtgctttacgcggtgggagccacctcggtgatcctgtctgcggccaacggggcggatatcaaggtgctcaacatgtacagccgttcccccaaagcgttttccatgtacgctaaggacgacagcctgacaagccctgagagcctgaagggcaagaccgtcgcaggcccggcggggaccaaccttcacgagctgctggcagcctacctggccaccgggggtatgaccattcaggatgtcaactatgtgaatatgtccatcccggacgccaaagcggggctggacggcggcagcgtggacgtggctctgattgcaggcgccacggcttaccaggcgcagcagcagggataccacatggtggcggacggcgagggcctgatcaaggcgatcatcgcggtggccgtccgggaagatttttacaatgaaaaccgggatgtgatcgaccgcctgatggcggatcaggagaagatcgccgctttcatgagagacaaccaggaggagactttaaagattgtggcacaggagctggatctggacgagcaggccgtgaaggacatgtacgcctgctatgatttctccctggatgtaagcgacgaggaccgcgcgggcttccagaaaacggccgacttcatgctggaggccggcatgatcgaggaaccgctggatgtaaacacgctatttttccaataataggggatcaaatttcagaacggatgaaaggcacctgcctccggagctccggtttgctccgggcggcgggtgtcttttttgctggggaggccgggccgggaagcggccggcacggcggggagaaacgcgataaaaacgaattaagcctatgcaaattcgcggatatttgttataataaaaccaattagggccatattccggacgtttaacgccggaggcgccggatttatgcgcggcgcggcgaattatatcagacaggaggtatttgttgtggcggaagcggagaatcgcagtacccataaagtatatgagaaagacaagatcggagaagtccagattgcagacgaggtggtggcgatcatcgccgggctggcggccacggaggtggaaggtgtcgcgtccatggcgggcaacatcaccaatgagctggtgggcaagctgggcatgaagaatctgagcaagggcgtcaaggtggaggtgacggaggagcatgtttccgtggatctctccctgtatatccggttcggatataacatccccgaggtcagcgagaaggtacaggacaaggtgcgcacggccatcgagaatatgaccgggctcaccgtgctggatgtgaacatcaaaattgccggcgtcagcatggacgaaaaccggtaattacatggcctgcacggcctgataccagactccccggacatgggcgccggggagttttatacatttttaattgtttttatgcattgaatttggtataatcaaggaaacgcatcacttatcatcagcctgtcggctgatgacaaggtataatcaaggaaaccccaggtacccggtccgggcgggaccgcctttgccggggatccactatggaatgaagaaaggaaaccaacgaaatgaccagaagagaattgcgggaacactgctttaagatgctgttttccgctgacttctacccctcggcggaggaagtgaaggagcagcttaagcagtatttcaacgcgcccgaggaggatgatgtggaccccaagggggatgtgacgatcctgcataaggtggagataaaggaggaggacagccgttacctggaaaaacgcgtggccgggattatggacaagattccggagatcgacggccagatcaacgaagtggcggccggctggcgcaccaagcgcatgggcaaggtggagctgacgatcctgcgcctggcgctgttcgagatgaagtacgacgattccatcccggagaaggtggcaatcaacgaggcggtggagcttgccaagaagttcggcggcgacgagtcaccgtccttcgtcaacggtatcctggcgaaattcgccggcaaggctgccggcagaaccggcggcgaagcggaggcggacaagcctgccggctccgcggccaatccggaggccgcttcaccggccaatccggaagccgtctccccgtcccccgaagaacctgaaaagaccggaacggaaaaagcataaggcggcggaaacatggggagtatttatactgtatcgcaggtgaattcctacattaaaaacatgtttacccaggattttgccctgaacaaaatatccgtcaagggagaggtttccaactgcaaataccacccatcgggccatatatatttcacattgaaggacggcggctcccagatcggagccgtgatgtttgcctcccagaggaaaaatctgggattcaggatggaggaaggccagcaggtggtggcggagggaaccgtggacgtgtacgagcgggacggaaaataccagctctacgccaggtccgttacgctggacggcaccggcgatctcttccgcagattcgaacagcttagaaacgagctggaggagatggggatgttcgacggctgttacaagcagcccattcccagatacgcaaagcgcgttggcgtggtgacggccagcacaggggcggccatccgggacatcatgaacatttccgcccggcgcaacccttatgtccagctgattctgtatccggctctggtccagggggccggggccaaatacagcattgtgaaaggcatacagaccctggatcgtatgaatctggacgtgatcatcgtcggcagaggcggcggctccatcgaggatttgtgggcctttaacgaggagatggtggcgcgtgctattttcgagtgcggaacgccggtgatctcagcggttggccacgagacggatgtgaccattgcggactatgtggcggacatgcgcgcccccacgccctcggcggcggcggagctggccgtgttcgactacagccagtttgaggcccagacggacctctaccggagaaccttaaaccggggcatggagcgcaggctggagcgggtgcgctaccgcctgaaccaggacgtgctgcgcctgaaaatgcaccacccggagcggcagctcaacgagaaacgccagcgcctggccgacctggaggaccacatggggcggatcatggagcggcgggtcaccgccggacgccacaggctggcgctgctggcggggcgtctccagtcgctgtcgcctctggagcagatcagccgcggctacggattcatcaccgacggcgggggaaaacgcctggagtccgtttcccaggtaaagcccggagaccggatcactgtccgggtgcgggacggaagagccgtcgcccgcgtggaggagacggaatccttagatgataggaaaggcggagagctgacatgacgaaaagcgcaaagagcgccggaggtcaggagacggccggcagagagccgggcatcgaggagaccttcgaggcgttggaagagatggttaaaaaactggaggacggcgagaacacgctggaagaatcctttgcctgctacgagcaggggatgaagctggtgaaaacgctgaacgcacagattgacaaagtggaaaaacaaattctgatattgagcgagggtgatgaacatgagtgatatggaacagtttaaagcagaaatggagcgcaggacaaaggagatcgagcagataatcgagccgtacctgccggaggagaccgggcatcagaagacggtgcttgaggccatgaattacagcatgaaggccggcggaaagcgcctgcgccccatgcttatgcaggaggtctgccgactgttcaccggggatgtgctggactgcgtgatcccctttatggcggcggtggagatgattcacacgtcctcgctggttcacgacgacttgccgtgtatggacgacgaccgtctgcgccgtggcaagcccagcacctgggcagagtacggcgaggacatcggcgtgctgaccggcgacgcgctgatgatgtatgcctttgagacggcggccaggtcctttgagaccagcatcgaccccgatgagatttccgccatcgggcgctccatcggcattttagcccacaagaccggcgccttcggcatgatcggcggccagaccgtggatgtggagctggcgggcagcgatattcccagggacaagctggatttcatctaccgcttaaagaccggcgcgctgttggaggcttccatgctgatcggcgcggtgctgggcggagctgcggaggaggactgcaagatcgtggagcgcctggcgtcccacatcggcatggcgttccagattcaggacgacatcctggacgtgaccggcagcgaagcggagcttggcaagcccgcgggcagcgatgcgcgcaacggcaagaccacttatgtgaccctggaaggactggagaaggcgaagaaggacgtagagcagctgtccgcacaggccatcgaggatctggaacagcttccgggcaacaacgaatttttggagaatctgatccgtatgctgatggatcgcaaaaaataagccggagtaagaaggatttcagaacatgatattggaacagataaaaggtccgcaggacatcaagcagatgtccctggaagagctgggacagctcgcacaggagataagagcgtttttaatcgagaagatcagccacacgggaggccatctggcctcaaaccttggcgtggtcgagcttaccattgcgatgtaccggacctttgacctgccggaagacaaggtcatatgggacgtggggcatcagtcctacacccacaaaattttaagcgggcgcatggcggaattcgacgagctgcgccagtacggagggctctccggctttcccaagcgcaaggagagcccctacgattgttttgacaccggtcacagctccacctccatctccgcgggccttggcatcgcccaggggcgggatattctggggcaggactacgaggtggtctccgtgatcggagacggagccttaaccggcggaatggcctacgaggcattgaacaacgcggcgcgcatgaagaagaatttcatcatcgtgctcaacgacaataaaatgtccatttccgagaacgtgggcggaatgtcgcgctatctgaacggcctgagaacaggcagcggctataacgacctgaagaaaaacgtggccaacgccctggaccggattcccgtggtgggcgcgcccatgatcgacaagatcaagcgcaccaagaacagcatcaagcagctgtttatcccggggatgctctttgagaatatgggcatcacctatctggggccggtggacgggcacaacatttcccagctctgcaaggtgtttcgggaggcgaaaaagctggatcacgcggtgctggtgcacgttttgaccaaaaagggcaagggctacaagccagcggagaaaaatccgtcccgtttccacggggtggacccctttgacgtgaccacggggaaatccctgaaggagaaaacgtatcccagctacaccgaggtattttcccgcaagctctgccagctggcggcggagcgccccaatgtggtggcgctgacagcggccatgccggacggcacgggcctttccgcttttgcccggcattatccggggcgtttctttgatgtggggattgccgaagcccacgcggttacttcggcggcagggatggccgcagccggtttgaagccggtggtagcggtctattcgtcgtttctccagcgggcctacgaccaggtactgcacgacgtctgtatccaggatcttccggtggtgttcgccgtggaccgggccgggctggtgggcagcgacggtgagacccatcagggaatcttcgactactcctttttgacatccatccccaacatgagcgtcatggcgcccaagaatctgtgggagctgcgcgccatgctggaattttccatggattacaaccgccccttggccatccgctatccccggggcgaggcttaccggggcctgcgggattttcgggaacccattgtctacggcaggggggaaatgctctacgaggaggaggggatcgctcttttagctgtgggaagcatggtcagcaccgcagagcacatccggcagaagctgaaggccgagggccgttcctgtaccctggccaacgggcgttttgtgaaacccttcgaccgagagctggtggaccgcctggcggagcggcacaaggtgatcgtcaccctggaggagaacgtgctgcaggggggatacggcctgcaggttaccgcctatatccacgagcattatccccaccgcagggtgttgaatatcgggcttcccgacgcgtatgtggaacacggaaacgtgtccgtgctgcgggagggcctgggcatcgacagcgattccattataaagaccatgaagagcaggggatatttggattagcgcgcggaactttgcggcggcaaaacccgacgggccgcgcgtccggaatttcagaagaaaagagaggaactttagcgggatgaaagaacggttggacgtactcctggtgcagagaaatctggcgccctccagggagaaggcgaaggcgctgatcatgtcgggcatcgtctatgtggacgggcagaaggaggataaggcgggcacgcagttcgatgaggcggccgccatcgaggtgcggggaagcaccctcaaatatgtgagccgcggcggccttaagctggagaaagccatgacgcatttcggcgtggagccggcgggaaaggtctgcatggacgtgggcgcctctaccggcggcttcacggactgtatgctgcaaaacggcgcggtgaaggtctattccgtggacgtgggccacgggcagctggactggaagctgcgcaacgacgagcgggtggtctgtatggaaaagaccaacatccgctacgtgaccccctccgacatcgcggaccccatcgcccttgccagcatcgatgtctccttcatttccctgaccaaagtattggggccggtgcgggaactgctgaccggggacggacaggtggtctgcctgatcaaaccccagtttgaggccgggcgcgagaaggtcggcaaaaaaggcgtggtgcgggaacggtccgtgcacctggaggtgatccgcatggtggtaagctatgcggtggaaaacggttttaaggtgttgaatctggaatactcgcccatcaagggaccggaggggaacatcgagtatctgctccatctgcagaagctctccggaggggagatgccccagaggccggaggaccttcccgtggctcccgcagccgtggtggaagcggcccactcgcagctggactagaggacgggggacggtatgagacacttttatataattgccaattatgacaaagaatatgtgctcgaggcggagacttttatccgctcctatctggaagggaagggcgcgcagtgcacggtgcagccggcatttccccaggactgcttaaaccggcacaccgggagcgccatggtgccgccggagatccagtgtgtgatcaccatcggcggggacggcaccctgatccaggcggccagggatctggccgggcgggatatcccgatggtgggcgtgaaccggggccatctgggcttcctaaaccagatcagccgccaggaggacatcgctccggtgatggacgcgctgctggaggaccgctatcagctggaatcacgcatgatgattcagggggaggccgtgcgggacgggcagaccgtgatgtgcgacattgcgctcaacgagatcgccgtgacccgcaaggacgccttaaaggcgttgcgcttcaaggtttatgtgaacgacgatttcctgaacgaatactccgcggacggaattctggtggccacgcccaccggctccaccgcctacaatttatcggccggcgggccggtgatcgcgccgggggccaaaatgatggtgctgacgcccatctgctcccacgcgttaaacgccaggagcatcgtcctggcgcctgaggactcggtccgaatcgactttgtgaacggcggccaggtggccgcatttgacggggatacatttattgaactggaaaaaggggacagcatccgtattaaacggtcggagatgcacacaatcatggtgaagctcaagcagatctcctttatgcagaatctgagcaatcatctggccggaagaatataggaggagacagacattatgaaagtagaacggcacagcaaaatcgtggagctgatcggcaagtatgagattgagacccaggaggagctggcggaaaagctgaacgaggcgggctttaacgtgacccaggccaccgtgtccagggacatccgggagctgaagctgacgaagatccaggcggacggaggccgtcagcgctatgtggtgcttgaggggccaaaggggacatccgccgccaaatttatccgggttttacaggacggctttatgtccatggatatggcccagaatattctggtgatcaagaccgtgtccggcatggccatggccgtggcggccgccctggatgcaattcacttccatgagatcgtaggctgcatcgccggggacgacaccatcatgtgcgctatccgcagcgtggacgacaccattatcgtgatggagaagatcaagaagatggtggagggatagtttgccgccgggcccgcgctcaccgcgttggccgcgagaaaagggggatttcaatgttactggaattgcatgtgaagaacctggctctgatcgagaaagcggacgtggagttccgtcagggcttaaatatcctcaccggcgagacgggggccggtaaatccattatcatcggctccgtcggcatggcccttggcggcaaggcgtcccgggacagcatccgccagggcgcgccctacgcctacgtggagcttgtattctccgtggattctccggagaagttgaaagccctggccgccctggaggcggtgccggatgagaacggcctgttcatcatctcccggaaaatcatgccgaaccgtagcgtcagccggatcaacgacgagaccgtgaccacggaccggctgaagcagatcaccggcctgctgatcgacatccacggtcagcacgagcaccagtcccttctgtacaaatccaaacatctcgcgattctggacgcctatgtcaggggaaaaacccagcctttaaaagagaagacggcgaaaacctacgaggcttaccgggcccttcgggaaaaattggaaaaatttggagttgatgaggagagccgcatccgggagaaggatttcctgcgctttgagatcgatgagatcgaagccgcagagatccgggaaggcgaggaggaggaactgacggccctgtaccgccggttcagtcacagccgccgcatcgcggagaacctttccgccgtgcagcaggccctggagggggactggctgtcacgggcgctccaggaggcggaccaggcctgcgcctacgacgaatccttaaacggtatccgggaccagctctacgacgcggaatccatattgagcgacgcgggccgggagacggccgcctatctggagaatatggagctggacgaggaacgtttccgggaggtggaggagcgtctggacctgattcacggcctccaggcaaaatacggtaatacggcggaagcaattttccggaaactggaagaaaagaagcagcggttggacgagctggaaaatttcgaggagcgcaaagccgggacggagcgggagcttagaaagacggagcaggagctggaagcgctctgcggccagttatcccaggtgaggaagtccgcctcccggaagctgacggagagcatccgcaagggcctgctggatttgaactttctggacgtaaccttctccatggaattctccaggctggaccactacacggcccagggctacgacgaggcccagtttctgatctccaccaaccccggagagccggtaaagcctctgggcgacgtggcgtcgggaggcgagctctccaggatcatgctggccatcaagaccgtgttggcggacaccgacgacattcccaccctgatatttgacgagatcgacaccggcatcagcgggcgcacggctcagaaagtgtcggagaagctctcctatatcgggaggacccaccaggtgatctgcatcacccatcttccccagatcgccgcaatggcggactgccattttgagatcgccaagtccacggccgaggggcgtaccgccaccaccatccgcgccctggggacggaggaatccgtgcaggagctggcccggcttctgggcggcgcgaagatcaccgacgcggtgctgaaaaacgcccgggagatgaaggatctggcggacagcacaaaataaaaaagaatatcataaaagcggacaagaatcgcgaaaagatgctcatttttgataaaattgggcatctttttttgcgttgttgggagaacttctatttgaaagcgcgttagagagttgaagaatgcttttggcttatcgggacagaatacaggacatcaacacatcaggaggccgctatgaaagacaagcagaagagaatcattacaacacagaaaatcgacgactattgtttatggctggaccgctgcgagcggagcagggagacgattcaaaaatatgaatattacctgacccgttttatggagttcatggactgcaggccggtggacaaggagatggtgattctctggaaaagcattttgcgcgaaaatctggcgcccgtaaccgtaaacggagccctggccgcgctgaacggttttttcaaatactgcgattggcaggattgcagggctcgtttcctgaaaatcagtaaaaacaccttttatcccgaaagccgggaactctcaaaaaaagagtatctccgcctggtaaggacggccgcggtccagggaaacgaacggcttgccctgctgcttgagaccatctgctccagcggaatccgcgtgtcggagcttccgtttatcacggtggcggcgctccataaggggcaggcggaggtggagtgcaagggcaggatccggacggtgctgctgacaaaaaagctttgcagaattttgctggattacgctgccaggagggggattgagagcggaatgatctttgtgacgagaagcggaaaggctctgaaccggagcaatatctggagggagatgaaggcgctgggcccgaaagccaacgtagaccgggagaaaatatttccccacaacctgaggcatttatttgccaggacctactacgcaatgaccaaggacctgtcaaagctggcggatatattgggccataaggatatcaatacaacccgtatttacactgttgagagcgggagcagacacagaaaacagctggaaagtatgagactcattgcgacgccgtacaacgcaatatctattttgttgtattccgaaacatgggcgcggtaaatcatttcatactatatcacatttttacatagatttccaccggtttccgccactatggacatgccaatcagacctggcgtcattcggctccaggcctgattagttggcgtccctaaaaatgggctcttttggcagatttatccggaaaattgccgttctcgaaatgacctttggccgttcggttacaacaaaatagatattgcgttgtaaatggagggaggggaaaataccggggtggagcggagcatgggcgcaggcggcattttaccatacaggaaggggagaaatatgtttagggatcacatacctggagatgataaggaaacacgaatcaatacaaacgacgcgagtatcatgctggtctgcatcaacggataccaggagaaccggccgtacggggtgattgtaaactactgcctgccggctcccgtctattttacggggattcatgagctgatcctcagggtggatgaggtctgcgagcggatcggcgcgcccatgcgtaccatggagccccgctttttgagccgcgctgaggcagagcggtaccagaagctgccgctgccgcaggaggcgggaacgcaaatcggtccggatcaaagggccatgccgatacaggagcggctggctgatacggcgcaggccgaggaagttctgatcatccatgtgctttacaggcagcacgcctccatgcagggccgtctgcacaccagtttctccggccaatactacgtctccttccgcagcgctctggagctcatgcggatgctggcggaggtggatgcaggtctgcgggagaaggggccgaggaagcggctgaccgggggtggaggaggtcgggcggacgaaggggaccgggaggcggctgaccgcttgaaaatttaaaaaatccggattaaagccgaaggcgcgtaaaaatattgtatgaatgaaggatttggcagacgggacaaaataaaacagattgaaaacagaagatcagatcatactaagaaagaggcacaaaacaccggcttctttctttttttgactgtaatggaccgctggcgcagcccggggaggattgcagcgttccagaagccgatgggtgcctcgccctgtgaaaatcaacaaaatacaagacgaggaggtaagaacatgagaggaaataagacgttttaccggtggctgaaccgtattttctgggcggcgctcaccgtcaccgttggatattcctggtactacttagacactgccatcccggaccggatcagcattgtccaggaccagaaggagcagttttcgttcccgcttcccatcaacacaaccttatccagtgagagtgaggaagtggtgttgggaaacaagagcaacatacccgccgaccagatcacggtgaacgggaggcagccattttccatgtacgccgaaaaccagggatcctatcaggttgggctgaagctcttcggcctgattaagttcaaggacatccaggtggacgtggtggacacccgctatgcggtgccctgcggatgtcccatcggtatctatctgaaatccgacggaatcatggtcatcggcaccggaaagctgacggcggcggacggcatggaggtggagccggcctacggtattttgaaatcaggcgattacattgaagcgttcaacggaaagcccatgaacaccaaggaagatctcatggacgcggtgaacaagacgggaggcgaggccgcagtcgtctcggtccgccggggcggcgaacaggtggacgtcagcgtgaaccccgtcaagacagaggacgggcagtacaagctgggcgcctgggtgcgggacgacacccagggaatcggcaccgtcacatacctggatttaaacggaaacttcggcgcgctggggcatggcatcagcgacagcgacaccggcgacctggtggagaccagcaagggcgagttgtacactacccagattatgggaattgagaaggggagcatcggaaaaccggggctgctgtccggggtgatctattacggaccgggctcgctgatgggcgagatcaacaagaacaccaatgagggaatatttggaaatgtaaacgacgcctttttgcgtcagaccggcatggaggccatggtgaagggaaatgcggagggcagcggcctgccggaaggcgctatggagatagcctgccgccaggaagtgaagcccgggcctgcgaccatcaggagcagcgtgtcgggggagctgagggattatgatatcgagatacaaaaggtagattataactcggggcataagaataaaagtatggtaatcaaggtcacagatccggatctgatcgcgctgaccgggggaattgtgcaggggatgagcggcagcccgattatccaggacggcaagctggccggggctgtgacccatgtgtttttgcaggacagtaccagggggtatggtatattgattgagaatatgttggaggcggcgggggagtagagccggaacgctccgggccgtctgggtttcgctctgagggcgcaggtgacctccgccacctgcgcccgaattctccgcgaaacgtccgctcccgcaaatattgcccgctgcgcagctccaaattgacggattccatgttttgttgtaagataggctgagaagttatcttaataacattacaggagggggatacaatgtttgatctgtcaaaatgcattctggtcaccaacaatgaccgggcggcggaaaaatggagggattcggtgagccaggtgtttctgctcggcacctacggggaggtgctggaaaaggcaagggacctgattcacacgaagcataagctcctcacccatccccaggcttccagcttaaaacccaaccagacgccgtaccggaccattctcctgtaccagcagacggaggaggacaacacgggggacgtgtgcctgatcgaggaggccatggagacatttgaaaagtggaacaggatccgccaaacgccggagtacggagaaaacgtggactacgactacaagaccatcgatttgtccatgattgagaatgtcattcccagactctaaagcgtgtctgaaaaatacaagaacagaggaaaacagaaatgaagaaaaccaacggaacgccctactttaaagatttgagcaggaaggattacgtggtgatggccagccgcattatcaaatcggaaggcgtgggcgccatcagcatccgccgaatcgccacagagcttggatgttcctccgccagcatgtaccggtatttcaaaaatctggacgagcttttgttttacgcccagctggatgcgttaaacgagtacatattggagctgtctaaccgcgagaaggagtggaagggaatctgggacatgtatttcgggatctggcgggcctacgccaccgaggcgtttaagaagccggaggcctttgagtgcattttctaccggaatatcaacaaggatttgggcgaggcgctgagagagtattatgagatgttcccggaggccatcgtgcgggtgagtcctttgatcaaggagatgctggagataccgggctactatgaccgcgactatctgatctgccggcgtctggtggaggagaaggagatcgcggaggagaacgccagaaaactgaaccatgtcctgtgtacgctgttcctgggatactttaagtttgtacaggaaaatgccgtggagcgggataaaattcaggagttggtggagcagtacatcgccgagagcgtggacatcgcgcagatctataccgaaacgaagctgcacaaaattctgtaacacgccgccgtctgtccgcggcgtggcagaacccggctggtgaaaatgtacaaaaacgctgataaaattataacagtttgacgaaaaccgtgaaatctacggaaagtaacaaaaaacttcataaaccctattgataatcgcgataacatatggtatattttgatcataagttatcgcgattacttcatttgttctgtgaattttttacaaaacacatatctttgcagcaaaatgatgctgccggggccggccaagtgggtgaaataaatggggcgggcccggcggcaaatttcaagaagtgggaggtattttaaatgaagcttgaattgggcaaaatcttgatcaaagatatccgattcgaccaatcgactcacgtgaaggacggggttctctatgtcaacaaagaggaagttgagaagcttgtgctccaggacgagaagctggccggctgccatattgacatcgccaggcccggcgagtcggtgagaatcacgccggttaaggacgtgatcgagcccagggtcaaggtcagcggcggcgatattttcccgggcgtgatcggaaaagtgagtccccaggtgggaaccggcaggacccatgcgctggacggctgctgcgtggtgaccgcgggtaagatcgtgggcttccaggagggcgttatcgacatgagcggtccggcggcggactactgcccgttttccaagacctgcaacctctgcgtggtggtggagccggccgacggtctggagactcacgtgtacgagaaggcggcccgcatggccgggctgaaggtggcggcttacctgggcgaggcggggcggaacctggagccggacgagatcctggagtttgagacaaagccgatttttgagcaggcaaaccagtatccggacctgcccagggttggatacatccacatgctgcagtcccaggggctgctccacgacacctactactacggcgtggatgccaaacagtttatccccaccttcatgtatcccacggaaatcatggacggggccattgtctccggcaactgcgtggcgccctgcgacaaggtcaccacctaccaccatctccacaacccggttattgaggactgctacaagcaccatggcaaggacatcaatttcatgggcgtgatcctgaccaatgagaatgtattcctggcggacaaggagcgtcactccgacatggtggccaagctctgcaactggatggggctggacggcgtgctgatcactgaggagggatacggcaatcccgacacggatctgatgatgaactgccgcaaggtggagcgggccggaaccaaagtagttctgatcaccgacgaattcccgggcaaggacggaaagtcccagtccctggcggatgtgtgcgaggaagcggatgcgctgtcttcctgcggacagggcaacgccaccctggtgttcccggccatggagaaggtgatcggcacccaggacttcatcgagatgcagatcggaggctgggacggctgcaagaatccggacggcagcttcgaggcggagcttcagatcattatcgcctccaccattgccaacggcttcaacaagctggcggcccggggctactaaaaactgtaaaggagaggaaagaatggccatatataaagtaattcattatatcaaccagttcttcgccggcatcggcggagaggaaaaagccgaccacaggccggaagtccgggacggagccgtgggccccggcagagggctgcaggccgcgttgggagcggactttgagatcgccgctaccgtgatctgcggcgacaactatttcggcgaaaatctggaccaggcgacggatacgattctggagatggtgcgccgttatgagccggatgtgtttgtggccggaccggcgttcaacgccgggcgctacggcgtggcctgcggcaccatctgcaaggctgtggaggagcgtctggggattccggtgctcaccggaatgtacattgagaaccccggagtggatatgttccgcaaggacctgatcattgtggaaaccccaaattccgcggccggtatgcccaaggtgctgcccgtgatggccgctctgacgaagaagctggcccagggcggggagatcgccggacctaaggaggaaggatacattgagcgcggaatccgcgtgaactattttgcggagaagagagggtccgagcgggcggtggagatgctggtgaaaaagctggccggccagccctttgagacggacctgcccatgcccaagttcgaccgggtggctcccgccgcccctgtcacggatatcagaaaggccaagatcgccgtggttacctccggcggcatcgtgcccacgggaaatccggaccacatcgagtcgtccaacgccaccaaatggggcaagtacgacattaccggcatggaccggctttcagcggatgatttcacatccattcacggcggctacgaccgtcagttcgccatcgcggaccccaatgtggtggtccccctggacgctttgagggagctggagcgggaaggcgagttcggtgagctcgtcaactacttctgctctactaccggaaccggaaccgccaccgcatcggcggccaagttcggaaccgagattggaaaaatgttcgtggacgaacatgtggacggggttatcctcgtctccacctgagggacctgtactcgttgcggtgcaacgatggtgaaaggtatcgaaaagtacggacttcctgtagtccacatggcaaccgttgtccccatctccctgacaatcggtgccaaccgtatcatcccgggcgtcggcataccctacccacttggcgatccgccccagggtgagaaagacagctataaactccgcttatccatggtcagaagagcgctcaaggcccttcagactccggtggacggccaaaccgtgtttgaaaagtaactgcggcagcagccggccggcacggcaggccctgcccgccgtgccggtaccaaaaccggactcacggataggaggaggcctatgggtcaaaatcaaaaagtcagctggaaccgggtgctcatacttgcgggcgcggttatcgcgtttaccatcggttccggcttcgctaccggacaggaaattgtccaatactttaccgcgtatggggtggagggaattctgaccgttcttctgttcgcggcctgctttatctactacaattacaattttgccaaggccggggcggaggagcattttgagcggggaaatgacgtctacaggttttattgcggtaaatacatcggaaccctgatggattactattctaccattttctgctatatgtcgtttttcgtgatggtgggaggcgcggcctccacgtttaaccagcagtacggccttcccctgtgggtgggcggcacggttctgaccgcgctcaccatcctgacggttgtgggcggattaaattccatggtggacaagatcggcatcgtgggaccggccattgtcgtgctctgtatcggcatcggcgtcatcaccctcgcccgggacgcgggcagcgtgggcgccggactggaaatcatcaaaacgggcgctttcgcccaggcgggcggcgagacgatcaagaacgccgggccgaactgggtgatctccggtctgtcctacgccggctttgtcctcctgtggtttgccagctttacggccgcactgggggccaacaataaaaagaaagatgtggaatacggcatttacggcggaactgtggcggtgtgcgcggccatcatcctgatcatgcttgcgcagattgccaatatcaacacgccggggatcagcttacagggcatttttgtgtggaacgccaacatccccaacctgatcctggcggagcggatctggcggccctttgcctccattttcgccatcgtggtgtttgcgggaatctataccaccgcggtgccgcttctctataatccctgcgccaggttcgccaaagagggaacgaaccggttcaggattctgaccgtggctctcggacttctgggattattcgtgggactcttcctccccttccgggtcctggtcaatgtgatttacgtgctcaacggatatgtgggagccgttctgatcgtgttcatgctgtggaaaaatatcaaagatgtctgccggaaaaaacaatagtatgaagatttttattgtggactgcgacaggacgtcgcggtcggaattaagaaatatgatcgaggcgggaaatctggggattgtggtgggcgcttcgcccaggtgggaggaagcgtatgtaagagtgcaggaggtggggccggacgtggttttggcggacctggaattctgcacccctaaatccatggtctacattgaaaaggtgagggcggtgatgccggagactgcggtggtggcattgtcccaggccggccacccccaaacactgcggcaggcctacgagaagggcgtcgagcttatgatccacaagcctttaaatgagattgaagtgcgcaacgtgctgtacaatctggagatggcccgggccatgaaatggcttttgggcaaagccgggcgcggcgccggtgagatggaggcgcaaaacggcgccccaggctctcagggggctgcgtccgccgatcccggcccgccgaccagaaggctgcggggaattctccaggagctgggagtgctgaacgactgcggaagccgggatatactgggaattgtccgctatctgattgagaagaacattgaactgcgggatgtcacgatccgggagctctgcgccagaatgggagaaaatcccaaaagtgtggagcagcgcatccgcaggacagccgccgccggcatggccaatctggccgtccggggattggaggattacgcggacccggtattcaacgagtacgcggcccgtctgtacagctccgagcagatccgccgggagatgaactatatccggggcaggagcgagcagcacggaaacgtgcgggtgcgccggtttctgggagggctgctggagtgctgccgtgaggcgtgagaaaacgccgtgatcccggcggatgggtttctgttttacgatatcagcggaatccggcgcccggccgcagacagccggggcgcgggcacatccgtttttgtggaggcattgaaatggaaatgatttatgatttgatcatcctgggcgccggacctgcgggccttgcggcgggactttacggcggcagataccgcctgaacacccttttgattgagcggggccaggacggcgggcagatcgccatcacctcggaaatcgaaaattatccgggacagatggtggaccaggaggaatccggcgccaccctgaccgcccgcatgaccaggcaggcggagaagtttggcgtccaccgggccggcgccaccatcgccagggcggagctttccggaccggtgaagcgcctgaccgacacccggggaaatgtgtacgagggcaaaaccgtgattctcgccaccggagcccaccccagacccattggctgtaagaacgagcgggaatttctcggcaagggcatatccttctgcgccacctgcgacgccaatttttacgagggcatggaggtctttgtggtgggcggcggcgactccgcggtggaggaggccatgtatctgaccaaatttgccagaaaggtaacggtgattcaccgccgggaccagctgcgggcggccgtttccatccaggagaaagcgttccggaacgaaaagctccattttatgtgggattccgttgtggacgaggtgagcggcgacggcatcctggaccgcatggtggtgcggaatgtgaaaacaggggagctgaccgaggttttggcggatccggaggacgggatgttcggccttttcggcttcatcggctatctgcccaacacggagctgtttgcggatgcgggtcttgagatggagaacggttacatccgcacggacgaggacatgcaaaccaaccttcccggcgtctacgcggccggggatctgcgggtgaaatcactgcgccaggtcgtcaccgcggcggcggacggagccattgcggccagccgggcggagcgttatgtgtcggagctggaatagcgcggcatatgacaaaaaagtacagaaggacttgcttatacacaggaactattatataatacagacaaaagtaatcgcgattacatagagcggtacacgaatccgaaaggaggatgcgacagtggtcgatttgacgaaggaaaactttgatgaggaagtgctgaatgcacagggatatgttctggtggacttttacggcgacgggtgcgtgccctgcgcggcccttatgcctcacatccacggctttgaggaaatctacgggcagaccgtgaagttctgctccctgaatacgaccaaggccagacgccttgcgatctcccagaaggtgctgggacttcccgtgatcgccgtctacaaggacggagtgatgatcgattccagggtgaaggacgaagccacgccggaggcatgcgaggaaatgatcaaaacctacgcctgagggcgggagtgaagtgcgctgcatagccgccagacggcttatgtataaaaatgaggaataggagggaaacgcatggcaattttaaaggataagtacgccatcatcatcggtgaccgcgacggcgtgccgggaccggccatcgaagagtgcgccaggacagccggcgcaaagattgcatactcctcgacggaatgcttcgtctgaacgtccgcgggtgccatggatctggaaaaccagaaaagggttttaaagttaagtgaggagtacggaccggagaacgttgtagttctcctgggagctgcagaagcggaagctgccggcctggccgcagaaaccgttaccgcaggtgatcctacttacgcaggtcctttggcaggagtccagttgggactaaatgtatatcacatttgcgaagatgaagtgaaatcggagacagacccgtctgtgtacgacgagcaggtgggcatgatggagatggtgatggatgttcccgcgatccacgaggaagtgggaaagatccgcgaagagttcggcaagtattgatccggagcctgcccggcagcgcccgggccggacggatcggccgggttcacggcagcgcttgtggcaggaggcccgggccggggacaaaaatccccggcggccgcccggccccaagcgtgccggggccgggatctcagatgaaatgtgggggattattagatgaacgattatccggttatcaagggaaccagctataccctggcggcggcgccagatatggttttatataacggcacgacccagaccacggagcggattgtgaaccccggctccgggtacctggaggaactgcccggacatctgcgggaatacggggatgtgctctcctatattcccaaccaggtatacataggcaacgcctcccacgaggagctgcgcggcacggagtttccgtactacgacaaaaagtgggaagcggccaaggaggacgggccctttggcctgatcatccctgaggacgaattttacggagtcatgcacatctgcgacgtgtttgagctggtggcgctggaacagggctttgctcagacggtgaaggaaaagctggcgcggcgcggcatgttcaccccggaacagctggacggactccttaaacataacggggaggcgcaggaattaaagcgcctggtggaggaggagcactccgagggcctctatctgcgcggcaacgagctggtgggcgtagtcaagcgcgcccacgacgtggacgtgaacctgtcggcccatgtgatgctggaaaatctggtatccaaggcatccaacgtcatttccctgattcagctgaggctgaaaaatgagttcaacccggacgatgtggaatatgtgatcgactgctgcgaggaagcctgcggggatatgaaccagaggggcggcggcaactttgccaaggcctccgctgagatcgcgggctatcgcaatgccaccggctcggacgtgcgcggattctgcgccgggccggcccacgccatgctccacgcggcggctctggtgaaggcaggcacctttaaaaacgtggtggtgaccgcgggcggctgtaccgccaagctgggaatgaacgccaaggaccatgtgaagaaggggcttcccgtgctggaggactgcatcgcaggcttttccgtgctggtgtccgcggacgacggggtccacccgcaaatccgcacggatattgtgggctgtcacaagatcgccaccggctcagcgccccagatggtgataagcgccctggtggcggagccgttggagcgggcgggtctgaagttcacggacatcgacaaatacgcccctgagctgcagaatccggatatcaccaaacccgccggggcgggggatgtgccggaggccaactacaagatgatcgcggccctggcggtgatgaaaaagcagctgggacgggcggaaattccggattttgtgaaaaagcacgggatgaccggctgggcgcccacccagggccacattccctcaggggttccctatctggggccgcttatgcgggagtgcctggaggggactaccaggagcgctatgatcatcggcaaaggctctctgttcctgggccgcatgaccaacctgttcgacggagtgtccttcgtggtccaggccaatgagaaggcggcggagcgggaaaaacaggccgtggaagatgaagcggtggggaacgcggcggtgggagccgccacagtccaggcttcccggaccgttcttagccgcggcgcctgccccgggatcaagatcgtgtttgccctggagggcagcgagcacggggcgcaggagatggaacgggcgctgcagctggcggctgccaagggcataaacgccgtgatctgcgacgggccggacgcccaccgggccatggaggaggagctggctgccgggaaggcccaggccgccgtgaccatgcattatcccttccccatcggcgtatccaccgtgggtaaggtgatcacaccggccaggggcagggccatgtacattgccaacaccacgggcacctccgacacggaccgggtgagcgcgctggtgaaaaacgcgatcgccggaatcattgcggccaaggccgacggagtggagcatcctacggtgggcatcgccaatatcgacggagccagggcctgcgcaaagattctcaaaggcctgaaggaaaacggctacgacatccgctttgccgagtccgccagagcggacggaggcgtggagatgcgcggaaacgacctgcttatgggcacggccgacgtgatggtcatggattccctgaccggaaatctgatgatgaaaatgttctcctcctacaccacaggagggcagtacgaagccgtgggctacggctacggcccgggaatcggcgagggatacgacaagctggtcatgatcgtgtccagagcctccggagcgccggtgatcgccggggcaatggagtatgcggccagcctgattgcaggcggctggaaggagatcgcgcaggcggagtacgcggcggcccgcagggcggggctggatacgtttttggcggggagcgccccggccgggacggaacaggagcgggaggaagtagcctgcccgcccagggagattgtgactgcggtgatccccggaatcgaggtcatggacctggaggacgcggtgagagcgctgtggaaggctgggatctacgcggagagcggcatgggctgcaccggacccatcgtgcagatgtccgaggcgaaccgggagagagccgaggccatactgacccaggccggatacatcggataacgggaaataaaacagaattcgagcataacccggcggcagccagagtctgccgccgccgggaaactggagggagttgggtagctggtgcgccccgcggtcttcaaaaccgttgtgtggagttaagagcttcacgggtgggttcgattcccaccgcctccgctcgccgccccggcagggctttccccagggcggcgcaaatggagtttggctttgtaattgggagggagttgggtagctggtgcgccccgcggtcttcaaaaccgttgtgtggagttaggagcttcacgggtgggttcgattcccaccacctccgttttcttcaattatgtagcagctgtgagggggtatttcgatggaggataggcaggcgctgttgcgcgggcttcccaaagtagatgaggtgctgcaggatgagcgcctctttttgttttttgagagcacgccgcggccgttaatcgtggagactgtgcgggaggcggtgggggatctgcgcgccgccgtactgcggggggagacagagcggatcccctcccgggatgagcttgtggagcggattacgggggctctgacagagaagaacagacgggttctgcggcgggttctgaacgccacgggcgtggtgctgcacaccaatctgggccgggcgcggctgagcgcggaggcttcccgggcggttggggagatcgcggactcctactgtaccctggagtacgatatcagggccggagccagaggcagccgccaggatattgtggaagggatcgtgtgcagggtgacgggagcggaggccgctatggcggtgaacaacaatgctgcggccaccatgctggtgctggccgccctggcccggggcctggaggtggtggtttcccggggagagctggtggagatcggcggttccttccggattcccgacgtgatgagcgagtccggggccgttctgcgggaagtgggaaccaccaacaagacccgtttggcggattaccgcagcgtttgggcttcgggggtcaccggggcatttatgaaggttcacaccagcaactaccgcatcgttggctttaccgaggatgtgcctctggcctccatggcggagctggggcgggaactgtccgtgccggtgatctacgacatgggcaacgggctgctggcggatctgtcccgctatggcctggaggagcccacggtgacggacgcgctgaaggcgggcgccgacgtggtgctcttctccggggacaagctgcttggcggtccccaggccggaatcatcgtgggccggaaaacgtacatcgaccgcatgaaaagtcatcccctggcccgggccttccgggtggacaagatgacgctggccgccctggaagccacctttacccagtacattgaccgggaccgcgctttaaaggacattccggtgctgcgcatgatctgcgccaaacccgaggaactgcgggcgcgggcggagcggtttggggaaatgctgacggccgcctgtccggggctgcgggtggaggtggaggcctgtgaggaccaggtgggcggcggcagcgctcccaccagccgtctgcccggctttggagtgtctgtgagacaggagggactgtccgcccagaagctggagcgcaggctgcggaaggcgccggtgcccctgatcgtgcgggtcggccatgaccgggttttggtggacgtgagaacgctggcggaggaggagctcgccttggcggtggaggcgtttgtctgtgcaaaaggtggtgagaattgatgcagaatattattgtgggaacggcagggcacgtggatcacggcaagacctgcctgatcaaggcgctgtccggattcgacacggaccggctgaaggaggagaagaagcgggggatcaccattgacctgggctttgccaacctgccaaacgatgcgggcctgcacatcggcatcatcgatgttccgggccacgaaaagtttgtgaaaaacatgctggccggcatcgggggcatcgacctggtgctgatggtcgtcgcgctggacgagggcgtgatgccccagacaacggaacattttgagattctcaagatgcttcacatccgccgggggatcctggtgctgaccaagtgcgacattgtggacgaggagtgggctgagctggtggaggcggatgtggaggatatggtgaaggacagctttctggagggggctcccgtggtgcgggtatcctcctacaccggagagaatatcccgcagctgcgggacatgatcatccgcatggtctccgatctgggggccaggcgggaggaggcagagctgtttcgcctgccggtggaccgggtgttctccatggagggattcggcaccgtggtcacgggcacgctccaggagggaacggtgacggccggccaggaggtgatgctctatccccgggaacgcctggttaagatccgtggaatccagtcccacggcaagcgggaggaagccgcggccgcaggccagcgcacagccctgaacctgcaggggatcaagaaggaggaaatccgccggggggatgtgctggcctatccgggttccctggtcagatccattttagcggatgtgaagctctcggtctttcagaccagcggccgggagctgaagtccggggaccgggtccatttcaactacggttccgcccaggccatcgccaaggcggtgcttctggacgcagaacgaatcggcccgggggagagcgcctatgcccagcttaggttcgacgagcccattgtgctgaaacgcgacgaccgctttataatccgctttttgtccccggtggagacgtttggcggcgggattgtgctggacgcggcccctgtgcgccacaagcgcggggaatcgcaggccctggaagccctgaaggtgaaggagcgcgggacggagccggaggtgctggagctgatggtccgggaaaccagccggcagttcccgccgggaagccggttggctacggccatgaacctctcccgggcgcgggcggagtatctgattgaaaagctgagggcggccaggcgcattctcatactggccgacggctcggtgattcatatggattactggaatgagatcgccgcctttgcggaggaacttctggtggtataccaccgggaaaacccgatcagcgaggggatggacaaggaggagttcaagtccaggctcaacgagcagttccgcctgggggatatccgcagagccgccgtgcttttggccgagctggtcaagcgcatggcggtgaagacccagggcgcctttgtagcgggaaaagatttttccaccgagtactccaaggagctgagagggatgatggagcagatcggggcggagtacgccagggcgggaatcgaggcgccgctgaccgcggatgtgctgaacctgttccgggataaaaaccgggccaaacagatcatcgccgacatgcacaagaacgggcgtctggtcaagctgaatccggcctcctacatggacagccgggcctttgagcaggttgtggacggtttgcggacccatatgggcaagagcgggggatttacgctggccgaattccgggacatgtggggcacctcgcgcaaatatgcggtacagcttctggagtatacggataaaaagaagatcaccaaaatggtgggagataagcggattctgctgtagaagagggaggggaagcgatgatttatctcgataacggagcgaccacgttccataaaccggagagtgtgatccaggcggtggcggatgccatgcgctatatgggaaactccggcaggggcagccacgaggcctccttaaaggcttccaggatcatttacgacaccagggccatgctggcggccatgttcggcctgcgggatccctcccgtgtggcgtttacggccaattccacggagagcctgaacatggcgatccagggacttttctcacctggagaccacgtgatcaccacggcgctggagcacaactcggtgctgcgccctctgtaccgcctgcgggagcagggcgtggagctgaccatcgtcagggcggaccggcagggcaatatccgctatgaggatatccgggaagccgtgaagccctccaccaagggcgtggtttgcacccacggctccaacctgacgggaaacctggtggacatcggacgggtggggaagatctgcgctgagacggaaatcctcctggtggtggacgcctcccagaccgcgggagtgttcgacatcgacatggaggccatgggcatcgatgtgctgtgctttacgggccacaaaagtcttttgggcccccagggcacaggcgggatctgcgtgcgggagggagtggaggtgcggcccctggtagtggggggaagcggagttcagacatattcccaggcccatccgcgccagatgccggtggccctggaggccggcaccctgaacagccacggaatcgccgggcttcacgcggccttggcctttatcgaggagacgggcatggagcgcatttggtaccgggagcttatgctcatgcggcgcttttacgagggggtgcgcgccctgcccggggtcagagtgtacggggatttctcggacatggaccgccacgcccccattgtgacgctgaacatccgggattatgattccggggaggtggcggacgagctgatggagcggtacggcatctgcaccaggccgggagctcactgcgcgcccctgctgcacagagctctgggcaccgagggccagggagcggtccgcttttccatgtcctacttcaacacggaggaggaaatggacctggcggccatggcggtgcgggagctggcctcctgaatgcccgaacgtcgctggcgtgtccagaaagagaggatttggagatatgaggaaaccggagttgagattggtgattacattccacaccacgtcggaggccatggcgtgggagcgggcctgccgggatgaggaaataccggggaggctcatacccgttccacggcagatctccgcggactgcggcctgtcctggagtatgcctgtggatgggcgggagcgggtgcttgcggtgaccgctgcggcgggactgcgctgccagagcctgggagagttcgtgatttagaggcccccgcaggtgctttgctcatatacacattaatcacattaatatagaaggaaccggtatgccgtacgatggtataccggtccctttttcgaccgtttattccggcctgggcagatccaccagcgtgtggggatgtcccagggcgggcaggaccttgtccagaagatccctggttttaaatttgaggctggaggtgttgatacagggatggcaggcgaaatcttcgcgtgacagcacgtccttgtcgatcagcagccggacctgtttttccgtgtcgttcatcaggcccagcacagtgacggagccaggggtgagacccagcagggattccaaaaactccggctccgcgaaggataggcgggcgctgccaatctgctttgacagggcggctgtcttgaattttttgtcgccgggcatgagcaagaggtagaagtcggttttctgggcattgcgtaggaagagatttttgcagatttccgtgccaagcaggcggtccacctcctggcaggcctcgatggtgggcagggcgtcgtggtccacgcggctgtaggatacgttcagggaatccagcaggtcgtaggccctcagctccttgtccgaacgtcccgccgtgtccgccgggcgtccctggtacagggtgcggtcgatctggtaggtcaatggctctgatggcgtctggtttgtgtttgtcatttttacacctcggattgattcgttttttagttgaatgtgatggcgttcgagaatgttatcgcgttcacattgagcttttatcagtatatcagatttggagggaggttgcaatattgattgggcgtttaacgcgttttttgattggggaggcgggatttaagcagataataaagcgccgccgcgcctgcggttgaatcgcgggcgcggcggcgctttttgggatcggccggtatcagagcaggccgccgtactgaaggaacagcggtgcgaataccagggatacgatggtcatgagtttgatcaaaatgttaatggaaggaccggaggtatccttgaagggatcgcccaccgtgtcgcctaccacagccgctttgtgggcggggctgcccttgccgccgtggtggccttcctcaatgtattttttggcgttatcccaggcgccgccggagttggacatgaagatcgcggtcagaacgccggtcaccagggagccggtcagaagtccgcccagcgcggacgggcccaaaagcaggccgacgatcaggggagcggctaccgccatcaggccgggcaggaacatttcccgcagggcggccgtggtggagatggacacgcaggaggcgtagtccggtttgtccgtgcctgccaggatgcccggcttctcgcggaactgtctgcgcacctcctcgatcatctggtgcgcagccttggacacggattccatggtcatggcggagaacaggaaggtcagcatgccgccgatgaagaggccgatgattacgttggcgtccagaatgtcgatggtggtcagcttgaccgcctccgcgtaggagacgaagagggccagggccgtcagggccgcggagccgatggcaaagcccttgccgatggccgcggtggtgttgcccacggagtccagcttgtcggtgatctcgcggaccgagttgtccaggccggccatctccgcgatgcctccggcgttgtccgcgatggggccgtaggcgtcaatggctacggtgattccggtggtggagagcatgcccacggcagccagtgcgatgccgtagaggccgaccagtttataggacaggaaaatgcccacgcagaccagcagaatcggaatggcggtggactgcatgcccagggcgattccgctgatcacggtagtggcggagccggtttcggactgctcagccacccgctttacgaaacggtagtccccggaggtgtaaacctcggtgataaatccgatgagcacgcccaccagcaggcccacgatcacggcaaaggccgcattgaagctgccgaagaacatccggctgaggatcagggcgcagaccacaaccaatgcggtggcgctgtattcgccggttttcaatgccttgtgtgggtcgccgttcttgccggtctttatgatcagagcgccaaccacggaagccaggatgcccgccgccgacaacaggagcgggaacaggacgcccgcggtctgataggcgatgattcccagggtgagggcggagattaaggaacccacataggattcgaataagtccgcgcccatgccggccacgtcgcccacgttgtcgcccacattgtcggcgattacggccggattgcgggggtcgtcctcaggaataccggcttccaccttacccaccaggtccgcgccaacgtcggccgccttggtgtagatgccgccgcccacacgggcgaacagcgcgatggaggatgcgcccaggctgaagccggagagcacgcccacgtcgccggtgacgatataaagagttcccacgcccatgagtcccaggccaaccacggccatgcccatgacgctgccgccggagaacgcgatggagagcgcgcggttcatgccggaaactctcgccgcgttggcggtccggcagttggcgcggatcgccgcgctcattcccagataaccggctgcggtggagaaggcgcttcccaccagaaaacagcccgccgtaatccagctgtgggttcccaggccgatgaccacaaagagcacggccacaaagataacgagaacgcggtactccgcagccaaaaaggcccgggcgccctctgcgatggcgtcggcgatcactctcattttttcagttcccgggtcctgctttatgacctgggcgcgggtgacgaccgcgaacaggaagccgatcaggcccaccaccgggacaatccaatttaaatgttgcataataatcccctccttagattttcattcatccttctgaatgatcctaacactattgtaacagaggcggcgcaaatattcaacaaaatttttgaggcattaaaaatatttttgttataaatggggaggggagaaaagagaacacgtgcgtttaaagttatggacctgaatcccctgacttttagttttggggacgtcccggcggacagcggggacaccgatacaggtctgaacgggcacataagaaaatttatggaggatcatgcagagggacgttaacatacattacagcatcgcggacagagtagagacacgcgcaaaaacgggtggagaaggattgttttgcggatcattccctggaaaccgtatgcggattgacatggattgcggcagcttgcctgccgtcaggctgaaggagcatttaggtttgatcgattataccccccttgaaagagatgacggaagaaaaaattgctaaatagtggaaaatgttgcaaaaaaagcgttaatatagggcaacaatcgacgaattagacgaaaatatgttaaaattttgttaaaaccaattttaattgattgcttttcttcgggtttgatggtagaattgcaaaccatcacgtgtcaaatgttgcggtcataatttgttgcagtatgggaggagcgttgcttataatgtaatttgtcgggaatttgagatgaaaaaccgacaattatgtaaataagaaccctatggcaggaaaaaactgtaaattcgacaaaatgtgactgccgctaaaaaatgaaggggaggatttgagcattggcagagttaagcgtagcgattgtagacgacaatccaataattctgaatacactggatgagatattaaagaacgaagacggtttgtccgtaattggaaaagcagagaacggagaggaagcgatcaacatgatcaaggataaaacgccggatgtagtgctgttggacctgatcatgccaaagatcgacggaatatccgtcgtagagcgggtgaaaagcgaacatcctgcgatcaagaatcccgcatttatcattctcagcgcggtgggcggcgaacagatggccgaggaagcgtttcaggcgggagcgaattattacctgatgaagccctttgaccgggaggctctggtgaacaagatccgccacatcggcggccagcccaggaacgatcaggcaagggaagtgaaaccgcggtccgtaaaggaacagccgcgcctgagccgggaggagtacattgaggagcatttggaaaaggacatcacccgcatgctccacgagctgggaataccggctcatatcaaaggatatcagtatttgagggacgccatttccatggcggtgcaggactccgagatgatgacctcggtgacgaagattttgtatcccaccattgccaagaagcaccagaccacggccagccgcgtggaacgggccatccgtcatgccatcgaggtggcgtggggaagaggtaagatggaaaccattgatgaagtcttcggttatacggtcagcaccggaaaaggcaagcctacaaattctgaattcatcgcactgatatcggataaaatcaccttggagtacaaaaaaatttaagagaaaaacctaaaagacttcctaattacggaaaaataatgtatactatacagtagcagccgtaatggcgcctgtttttacaggagagggaggtttgaatgaagaagatattattcatggcttcggaagctgtaccgttcatcaaaaccggaggcttggcggacgttgttggttctctgccgaaatattgcgataaagagtattttgacgtgagggtgatgattcccaagtatctgtgcatcaaacaggagtggcttgagaagatgcagtatgtaaaccatttttatatggattacctgggtcagagccgctatgtaggtattttacagtacgaatatcagggaatcaccttttattttattgacaatgagagctatttcaacggatcgaagccctacggcgactggtactgggatctggagaagttctgcttcttctgctgggccggcctctccgcacttccggtgatcggtttccagccggatgtgatccactgccacgactggcagaccggcctggtgccggtgctgctcaaggaccgcttccacggaggcgacttcttccgcgatatcaagtccgtgatcaccatccacaacctgaagttccagggaatctgggatgtcaagacgatcaaaaagctgactatgctgccggactattacttcacccccgacaagctggaggcgtacaaggacggcaacctgttaaagggcgggatcgtctttgcggacgccatcaccacggtgagcaatacctacgcggaggagatcaagctgccgttttacggcgagggcttggacggcctgatgcgcgcgcgggcaggcagcctgcggggcatcgtcaacggcatcgactacgacgattttaacccggagaccgacgggagcatcgttcagcactacaacgcgaagaatttccgcaaggaaaaggttaagaataaaaaggcgctccaggcccagctgggactgccggtggacgagaagaagttcatggtgggtcttgtgtcccgcctgacggaccagaagggactggatctgatccagtgcgtgatggatgagctgtgcggcgaggacatgcagctggtggttctgggaaccggagacgagcgctacgagaacatgttccgccattacgcgtggaagtaccaggaccgggtttcagcgcagatttactattccgatgccctgtcgcgcatgatatacgcgggctgcgacgcgttcctgatgccgtcgctgtttgagccctgcggcctgagccagctgatggcgctgcggtacggcacggtgcccattgtgcgcgagaccggcggacttaaggacacggtggagccgtacaatgaattcgagagcaccggcaccggattttccttcgccaactacaacgcccatgagatgctgggcagcgtgcggtacgcgaaacacatttactacgacaagcgaagagagtggaataagatcatcgaccgcgctatggcgacggacttctcctggagggtttcggcaggaaagtatcaggagctctacgattggctgattggttgataaaagatttgggcgcccgggttagtcccgggggcccaaatatggattgaatgcaatgggcgcgggcgctgcgttgaggagaggcgatattcgattggaacattttaagacagacctgacagccggggacaggagaagccaggcggcccagtgggctgcggacgagacctgggtccggtgcagaaaatacgaaaacgatccggagtacatggagtgtgtgaaggacattctggcgcatccggtttttaattccatggatcagtatatacagcatgggaatactacgtgtaaaacccactgcatccaggtatcctatctgggctaccggatttgcaggcgatacggcgggaattggaggagcgctgcccgggcaggtctcctccacgatttgtttctgtacgactggcatacccatgcccgggagacgggggagcattttcacggtttcacccatccccgcagggcgctggagaatgcgtgcctgcattttcaactgacagacgaagaacagaatatcattctgcgccacatgtggccgctgactcccgtcccgccttccagcgcggcgggctttgccattgtctgggcggataaattctgcggcggggcggagacgctggggcggctgcgccatcttcgcctgctgcgcatgctgcagcccgccaggcattgagacgcatggatttttcggagccggaacaagaaaagggacttagggtagaatcaattaggagacggttggatgaagatttggaatgaaatactgagcaaccaggtgctggtgagtgcggttgcgggctggattgtggcccaggtgctgaaaacgatgctcgatttcgcgctgaaccgcacgataaattgggagcgcatggtgggttccggcggtatgccaagctcccactcggccaccgtgtgcgggctgaccacggctgccgcgctgcggtacggcgtgagctcctttgagttcgccgtgtgctttgtcctgtccatggtggtgatgtacgacgccaccggcgtgcggcgtgagaccggaaagcaggcgaagctgctgaattccatcctgagtgagaatccgctcaagctgaacgcggaggtgctgcaggagaagctgaaggagtatgtgggacacacaccgcttcaggtggtcgcaggggcgattctgggaatctgccttgcgctggtgattaacgggtattattaaatggaatgaggtgcggcaaaacggtataagggcagcttgaatgggggattgatcacatcgtcctggcaggacggatgggaggaactggaaaatgggtctttaccaaatgataaacttgttttttctgtacagttttcttggatatctcttggagtgcgccgtgctcagctttgaaaacagacgaccggtgatagaccgcggtttcgggcatggcccgttctgcgtgatctacggcgtgggcgcccttggggcatacatattgctgagccccatggtgggccggccggtggaactgtacaccgcttccatggcaatggcaacgaccatggagttgtttacggccaacatcatgatccgcctgtttggggcattctggtgggattacagccgaaagccgtttaattaccgcggcattatctgtctggagagcagcttggcctggggatttttgggattgtttttcttttattttttggacgcgcgggtgagacaggcggtggtgcggattcccggccatgttgggagtgtgctggccgtgggccttaccgtattttatctggcggattttatcgtctgcgtccgggcccgtctgggcggcgcggaggatgaggagccggtgatcgggcgtttgaaagtgttttgacaaattatgggggctgctgcaagcgcatgttttgtggcggccctgttttgagcgtaccggcaaaggcggctgcggccgcgggatgaattgagaaaaggagaacgacgggatgagcgttatgtggaagggaaggaatgtggtgctggcctccggatcgcccagacgccgggaattgctggctcaggtcgggatggagccggagattgttcccagtctggtggaggagtgtaccgaggagacggagccggatttgatggtgatggaattatcgcggatcaaggcggaggacgtggcttccagatgcccggaagggacgctggtgatcggggccgacaccatggtggccgtggataaagaggtgctgggaaagcccgggacgccggagcgggccgcggagatgattgagaagcttcagggaagggcgcaccaggtttataccggcgtgacgctgctgctggtggagcccgggggatgtttgcacgggaccacgtttgtggagaaaacggatgtgtatgtttaccccatgaccgatgaggaaatccgggactacgccgggtgcggggagccgctggataaggcgggggcatatggaatacagggccgttttgcggtgtatatccgcaaaattgacggcgattacgacaacgtggtggggcttccgctgggacggctctaccatgaactgaagaatttgacggaggatgacagggaagatgattaaactgatcgtatcggatgtggacggcacgctggtggaggatggttccggtggagtgaatccggagctgttcgaggtgattttgaagctgcgggaaaagggaattcagtttgcgattgccagcggccggccctgggccagcgttgagggagcgtttgagccggtcaagaagaagatattttatatcgccaacaacggggcgtatctgggctgccacggcaggagtctgtttgtaaatcccattgaaccggagctggtccgggaggtaatcgaagcggtgcgcaggcacccggatctgagtgcgatctacgcgggccaggacggggactacatggactcggaaaatgacgccttataccgctggatgctggagggatataaattcaacatccgccgggtgaaggatgtgctggccctggaggacccctgtatcaagatttccatttacaaggagcaggatgtggagcacgcggccgcggatatccgggaggcgtttcaggaccggatgaagattacgctggccggtgaaatgtggatggactgcatggctcagggcgtaaacaagggccaggccgtcaaacggcttcaggagagcctggagatccgcccggaggaaaccatggctttcggagaccagttaaatgatatcgagatgctgcagcaggcttattacagcttcgccgtggccaatgccagggaggaagtgcgcaaactggcgcgcttccaggcggacagcaacaaaaacgacggcgttttaaaagttttgaagcagttactttgaaaggagtttggagattgacgagagagcaccttagccgggggagaatattccgctgcggcctcgcggcggttgtactgatggtttttcttttggcggcgggctgcagcagaagcgctgcggttgagccgggcaaagaggaagtgaagcgatcctacaccaagggtcagctgatgaccattgcagccacggaacgaaaccgatatcagaatatttataccagccagatctggtcggtggaggacaagacgggcggagggaatttcgaggaccggctgaccgggcagattcgtcaatttttcatggagctgggaaccatgaacctgctggcggatgagaacggcattgagcttaccagccaggagaaggattccatcaagcgtttgtcggaacagtattacgggcttttgagcaaagcggaccgggactatatcggagcggatcaggaagaagtctacgaactatactgcgagtattaccgggcggacaagctggtgacggagctgacgcaggaccagaatctggaaatcagcgacgcggaggccaaagtgatcgaagtgctgcccatctcggtgaggaaccgccagaccgccgaggaggttctggcccaggctcaggcggagggcgcggatttctcagccattgccaagaaatattcaacggacggcggggtcgcggtgcagatggagcggaatcagaatcagagcgagctggagaaagcggcgtttgcgctggaacaggacgagatcagtgggattgtggaggaaaatggcgccttttacattttaaagtgcaccaacgcctacgacgaggcggcgactgcggcgcgcaagaaaaagttggcgcaggagaagaagaacaacgccttccaaaagatctacgcccccttcgcggacagccatgtggtggtgttcgacgagaaaatgtggtcggagatccactttgagggcggggaagggtccacgactaccaatttttttgaattgtaccacagttattttccaaaataatttcagagcgataaaatgaggccgtgggatgtcccgcggcctcattgtcagtgaaggagatgacccgctggccaggcctgcgggtcatcattggaatcaggcgttgcccagtcggaatacggtgagcgcgatgtcctcgtaggtgtaaccggcagcgtcggcgacaatgcggagggtcccggggcctgtagcccggaagggaacgctgaaggacatgttggccacttcgcctgtggcggtgaaggtgtgggttgacacagcccctggaatattggtaccgtcgaactcggcccgcagggtgagcgtggacgggatcgccgtaccggcatccactgcgatggagctctggaaggaaacctggtaaatgccgggttctgtgatctggatatccgtggatccggccgtatgggtgatcgcggtaccggataccagggggttctcgttgaaggtcagagcgcctcctgctacagaagcctgaccggtggagtccgtggtcgccaggacctcgggagcgccaccggcggaaccggtgggaccggtatctccacgggggattacaaagtcgaataccgcgttttcatccgtgccgctattggtaacttccgccggggtacccggttctccggtggtcacggagccgattgtgatagtggcggcagcgccggtgggaccggtctcgcccatggggccttcagggccgatggggccatccgcgccggtggggccaatggggccttcggcgccggtcgcgccatctgcaccggttgcgccgcgcgggatcacgaaatcaaagaccgcgttctcgctggtgccggtattggtgatctcggcggtggtgtccggctctccggtggtcacggtgccaaccgtaatggtggctgcggcgccggtggggccggtagcgccggtagcgccagtagcgccagtagcgccggtgggtccggttggaccggtggggccagtagcgccggtagggccggtcgggccggcagcgccagcagctccggcagggccggtagccccggtcgcgcctgccgcgccatccgcaccagttgcaccggttgcgccacggggaattacaaaatcaaagattgcatcctcgttggtgccggagttgttgacctcaacagggtcatccggttcgccggcaataacgctgcctacagatacggtggcagtacggcctctgggaccggttgcgccagtgggaccagttggtccggtggagccagtggggccggtcggtccggttgcaccggtcgcgccgctagctccggtggctccggcagccccggtcgggcccgtggcaccggtcgcgccagcagtgccgttagcaccggtaggccccgtggcgccggtcgcaccggttgcgccggcagcaccggtcgcgccggtgggtccagtgggtccggtgggaccggttgcgccagcagcaccgttagcgccagtgggcccggtgggtccggttgcaccgttgaggccgttggcacccgtgggtccagtgggtccggtagccccggaagcgccggttgcgcctgtaggtccagtgggtcccatggcaccgttcatgccgttggcgccggtgggtccggtgggaccggttggcccagtggcacccgtgggcccagtgggtcccatagcgccgttcataccattagcgcccgtgggtccagtgggtcccatggcaccgttcatgccgttggcaccggttggcccggtgggtcccgcagggccggggactcccggaaaaccctgtggtcctctggggccgattgggcccactgggccctgagggccgggataacctctgggtccgatgggaccctgcggtccggggcagcctctggggcccatgggcccttggggaccggtcggtccgcggttacaacaacaattacaacctctgggggcacatccgcctgctccggggcatctgcactcgtcaaatgccgcttcgtcaggattgcagcctccaggtgtatttccgcaatttgatccatttggataattataaaacatattgatcgctccttaataatcagtttttcaataacagtggccgatcttgctgagtatgatagtttgagtcttgactttttctgtatttgtccgtccccctgcaacagagagggccgccggtgtgaatggacaggcattgtccaatcgaaggaggggagatgacgggatgcagggcccgcaatgaaatgaacccgcatccgattggcggtctaatataccatatgaaaagtaaacaagtttggtgatacgagttgcagctcggaacctgttgaactgtttgaccaaaggatttatcccataaacaatcgcataccagcagcgcgtgtttttcgttattgccaataatgccgttgtctcatcaaaggaccataagtgttcgtttcatatttactcaaatggagaaaaatggtatctgtctctttgttggtaagcgcgcagacattacattccgactcataagcaccggaatcaggcagaataatacaacgtgatctgttccgaaatgattcctgcgtctgaaggaacggctccaccgttttatttgccgatcaaaataggaaagatggctggtagtaatgtcagctggcccggtacgtatctgcgcccctgtctgccggaagttctttgcagattgcagggattgttttcaagggatacgggatagaaaaattcattttattgcatggtttttcgtttagaatcagtaatattggcaaattacatcgaaaaacgggtgggcattgttgtccacccgttctgagctttaaatgaaaaatagatcgatactgcaggatgataagaaggttatcgtggcagctgcctcattagccagtacgatcataccgaattcatttcttataaccgttcccgtagatggcgtctgggtacttgtgttgatactaacgttgggtgttccgacaggcaggcgagagcgaatggttgattcgcaatcagagcaacagtcggtcggagcgggaaccggttctggtaaataggtaatagcatcattgtacgttgcattatttatttgaatcgtgtcgatactgcagatagacaaaaactgtgtgagattttgggaggttgtcacttcaaataatccggtttgtccatttggcccggggattaaagcgccagggcggccgacaactgcatcaccactccttaatgtgacaaatatattgttattgggatatagcgtaataatctgttggagtatatttcttatttgctccgtacatccacaacaggcagaattcgtattacccgtagggcctgtggggccggtaacgccggtggctccagtagggcctgtggggccggtaacaccgttggcaccggtgggccctgtggggcctgtaacaccgttggcaccggtgggccctgtgggaccggtaacgccgttggcgccagtgggtcctgtggggccggtaacgccgttggcgccagtgggtccggtgggtcctgtgacgccggttgcgccgttggcaccggtgggaccggtgataccgttagcccctgtaggcccagtagcaccagtggcgccggtgggtccgttggctcccgtaggcccggttggccccataatgccattcattccgttggtaccggttgcgcctgtagggccagtcggaccggggattccaggaaagccttggggccctctggggcctgcggggcctacgggcccctgggggccagtcggtccgcggttacaacaacagttacaatctctgggagcgtttccacctgctccgggacatctgcacatgtcaaatgccgattcgtcaggaggatagtttccagggatattaccacaatttgttcgatttggatcattataatacatagcgatcgctccttattttttaatcttccaacagcaggagccggtattgcccgtatcatgtactgcgtatctggcatccctgcagtggtccgcccccctgcggcagagggtttggcaggcgatttaaattgcctggcgtaatccaatgggaggaggggaaatggcaggatgtccgatttgcagcaaaacgaagggacatccgcccggcggtctagtataccatatgataagtaaacaagttttgtgaaatgcgcggcaggccggctgtcccggtcgcacttgcagcccattggagccgatgtaatgcagctaaaagaaaacaggctgcatgtcttgtaaataagatgaaacgtaacatgcaaacggttaaatggatcccggcaaaatgagatggtatccatttggcagtctggtataccatgtgaaatgaaaacaagcttttgaaaatataaagctggcgctggctctggggccaatgtttaaacaggtcagcgaatgcagtcggccattctgcccgccgcctcaattatggtcggaatatcagggctattaccgatcgttttacaggcatttttgaacgttgtgttaaaacccccggacagtttgaagtttctactatccgggggtgataattttgcgaaccggcgcgttttacgaaattgagaggccggcactcgcgtaacccgcaactgtgttaacaagagccacgccggaagcggtagtggaaaataccagcaaaagccttgttctcgcggtcaccggaatggagagtccgcttgtcagtccattggacaaactaccgatggagataacaccggtaagcgctggcgccagggtgacaactgctccggctatcggtgaaaaaatattgttcggcgtagtggactgatagagctgcgcccggattgtgatggtggagccggtcagggacagcgctgcagtggtgctgaaaaatgccgacagagcggtaattgttccgtcacgcggtacggaaaatgcaaagtttgttaacgtaccggcagcatttgtaaggtcaatcgtggcacccagcacactgacgctgggagcattgctgccaaagccaatcagcgatggaatgccggccaggccgccggctatggtggtcattgtcaatggcgttcccgatgagaagggaataatcgcggaagaacccgccactccggtcggcccggtggcgccggtaattccggcagtgccagtagccccggtagcgccagttggtccggttggcccggtaacgccagtagcgccggtgggtccggtggccccggtagcgccagtagcgccggtgggtccggtgggcccggtaataccgtttgccccagtgggtccagtcggcccggtgatgccgttcgccccggtgggtccggtgggcccgattaaaccgtttgccccggtgggtccggtcggcccggtgatgccgttcgccccggtgggtccggtgggcccgattaaaccgtttgctccggtgggacctgttggacctgcgggaatggtaaagagcagttgtgcaccgttcggcgtaaatgtttcatccacatttgcctgagtgccaggattgccggtcactgttccggctacggtaatgacaggagttgtgccgctggcacctgtcgttccggtggatccggttgcgccggccggtccggttggtccggtcggcccggttgcgccggttgcgccggtcggcccggtgatgccgttcgcgccggtgggtccagttggaccaatcgcgccgttcgccccggtgggtccggttggaccaatcgcgccgttcgctccggtgggtccagttggtccagtcgcgccgttcgccccagtggggccggttgccccggtcggcccggtgggtcccatggctccattaaggccattcgcccctgccggtccggtcggcccagtgggtcccatagctccgttaagcccattcgcccctgccggtccggtcggcccagtcggtcccatagctccgttaagcccattcgcccctgccggtccggtcggcccggtcgggcccatcgggccattggctccgtttaatccgttggccccggtggctccagtcggtccggtgggtcccatggctccgttaagcccatttgcccctgccggcccggttggtccggttggccccatcggtccgggctgtccgggatagccgaccggtccggtcgctccagttgcgcctgtgggtcccacataaccctgagggcccattgagccggtcggtcctgtgattccccgggggccctggcagccccgcggtcccatgggacccatcggtccctgaggacccatgggcccttgcggtccggtaggaccgcggttgcaacagttgcagcaattcgatccgggatatctgcgcgcgtcatatgcggccggatccggctcgcctcctccgggggcgccgccgtaattcattccattcgggtaattaaaacacataataatcgctccttattgtcgatgcctggcttctctgggaagctgtctgagattcaaatgcgtgatcggtacaccggaaacggttatggcggtcggttccggcagtgtgagaggatagcggcggggattttggagacagtccggccggacgctgtttaccaactcaatatactatatgaaaatcaaacaagtttggtgaacaagcctaaggcaaaggctgcgaagaaaaaggatgagaaaagccggggaagtcctccccggcaatccatgactcaaataaatgggcataattgtaaaaacactaaaacaccacagtacccgccatcccggcctggccgaaatgtaccagcagttctccggcagtctcgccgaccgcctgttccaccagagcggtcaggggtctgctctcttctgtatcccggtattcgatcagcgcttgccggatgggggccagaagacggcgctcgtcgatgcagctcggctcccggccgtgcacctgtgcatgaagaatgaaccctacgacgggaccaacgggcattttgagatggcgggccacggttgctgctgattgaaaataaagtggaattttgcccctgaaaagggaggaggccgaccggattcttccggtcggccagagtattatgaaaaaaagtcttgttggcattagctctttacatgatttagtatatccggtaaatgttaggaaagtttgttgaaatggtaacaattttgtgaacggaatgtgaggaggatgtgaacaggttatccttcctcatcttgaaagagcttgtcaaaatacaactggttctgtttaacggcctccgcctccggcttcaattccctggccagaaggtgatattcgcgggcctttttgtggtcgcccaggcggtcgaagcacacgcacagctgcatatacgggatatacccgtagcagtcctgtagcacaaatgcgccggaggtgtcccggggcgtgagctccagggcccgctggtaccagtaggcggcggtcttgtaagcgtgttccccaatcagcaggcggccgatctcgcagagaatttccgccctgggctcgtcgtagagaaaactgcccgtcagagccaggaacgcctcccgcttctgcccaagctgttcccggcagcgggacagctgcaggcaggcgtcgatccggttttccacccagccgtcgggttcctccagaaaatgctcgaagactttgacggcctcctcatatctctggtgataatacagctcgcgcccatagtaaaactgatggcgcgggcaaagtgtttcgccctccccgatcatggtctcatagatcttgaggttccggtcgctgtccccggcggcgagcttgcggtgctcgatttccaccggcgaatagagaatattgccgcggggtgtgaccgcctcgtggactctgccttcccacaaaaagccccggcggtttttgatcagccgctcgcggtaataggaaaatgtcacatggccgttctggtcgaagccggtcagatatttcatcatcacaatgtccgtggccggatttaacgattccttcagcctcagcagaagcttctgctggtccgggcggatcacgtcgtccgcgtccagccacatccaataatccatggacgcctttgaacaggcaaagtttctggctgctgcgaagtcctggtgccatttgtaatcaaacacgtgatcggtgaactgtgcggcaatttccctggtccggtctgcggagccggtgtccacgacaatgatttcgtctgcaatccccctcatttgctccagaacccgccccagaaccgcctcctcatttttgacaatcatacataaactgatggtaatcacggcgtcctccccgtatggtttaagatagagctgttttccagctcactattactatatgaaatgtgaacaagtttggtgaatgcaggacgctccgccgcggacggggcgtcctttttacgcccattttacatagaatttcccaaatcctggtagatggaatgaggaaaaatgtggtttgatagaagcgtcggcaagaatacaggcggccacaggccgtatggaaataaagggaggacgatctatgctggaacttagaaatctgaaaaagtcttatgacgggactatcattttacaggatgtgaatctgaagattgaggagggggagatcgtgtccattttggggccgtccgggtgcggtaagaccacgctgctcaacctgattctggggctgacggacgcggatgagggatccattgtgtttgacggcagggatattaccaatgtgccgatggaacagagagggttcaatattgtgttccaggattacgccctgttccccaacttaaacgtgtaccggaacattacatatggtctgaaaaacaagccggagatctgcacacgccaggaggtggaagagctgatcggccttttggggctgcgggaacatctgcacaagaagattgaacagctctccggcggtcagaagcagcgggtggccctggccaggaccatggtgatgaagccgaagattctgctgctggatgagcctttaagcgccctggacggcgtgatcaaggagtccatcaaggataaaatccggcagattgccagggattaccgcctgaccaccatcattgtgacccatgacccggaggaggcgctgaccctgtcggataaggtactgatcgtcaatgagggacgcatttcccagtacggcaggccggaggagatcatcggaacgcccggaaatgagttcgtgagagagtttatcctgaaccagctggtcatcaagcgcaacaatattttcacccttttcgggcaggatgccggagcgcagatggaaatgagggttgggtaggggatgagagcgagaaaggaactggaaataaaaggaatctatctggcggtgaccctgttgttcctggtttttctgctgattccgctgtgccgtctgttcttcaaatcctttgagaacgggggcgggctgaccctgaacaattaccgggaggtgctgacgggcaggggatttctggcggcgttcggcaacagcgtgaggatatccgtctgctgcggcctgttgtccacactgctggcatttctgcttgcatataccatacactacagcaacctgcccggcgcgttcaagcggttcatacgcagggcggcggtgatccccatgctgctgcccaccatcacctacggctttgccattatctactccttcggcaagcagggattgatcacgaagcttttcggacggcagctcttcgatctctacggcttttggggcctgctgctggggtatctgatctacacgctgccggtgtcgtttctgctggtatccgtgaccatggagtatattgataaaaagttttccgtggtatcccggattatgggggataagccctggcagacctttgtggggacggtggcccgcccgctgtcgggaaccctggcagcctcctttgtgcagtgctttttcctgtgctttacggattatggtattccggcgtccgtaggcggacgctacgaggtggtggccacggtgctctacaacgagatgttgggaagcctgcccaattttaaccggggttccgtggtagcggtgcttatgctggtgccttcggtgattaccatcgcgctgctccgctacctggaaaagtacaacatccgttacaacagaatttcccccattgagatccggaaaaacaggctgagggacgggcttctgggactggcaagcgcggcggtgctggcggtggtgctctctgtatttgcagtgatcttcctggttccctttgtggaggagtggccctacaaggtcagcttcaccaccggacatctgcggagcgtgctgcgggataaaagtctgctgggcgtgtaccggaattcactgctggccgcgtttatgaccgcctttttgggggcaatgaccacctacgcagcggcgctgtccacggccagaagccacctgccggaacgggggaagcgggtgattgaaaatatttccctgatcaccaataccataccgggaatggtggtcggcatcgcctatatgctggtttttaccggaacctctttgcagaacacattggcgctcattgtgatctgcaatgtgatccactatttttccaccccctatctgatgatgaaaaattccctggcgaaaatgaacgcctcctgggagacgacggccatgctcatgggcgacacctggctgaaaaccattgttcgggtggtgacgcccaatgccatggccacgattctggaagtgttcagctactattttgtcaacgccatggtgacggtcagcgcggtgatttttatcgccggggcgcggactatggtgatcaccacgaagatcaaggaattacagtattacaccaaatataatgaaattttcgtcctgtccattctgatactggctacaaacctggcggccaaagctttgttccgttttctggcgacagagcgcagggacgctgcgtccaggtgtctgccggccggagccggacgaattttaaaacaaatagcaggaggaacaaagtgatgagaagaatgaaaaaagcgtttgcggttgcggccgcatgcgggctgtgcgcggctgctgtgctgacgggctgccagaagaaggagcgggaggtggtgatctacaccaacgcggacgacgaggccatcgaggccatgaagggcgctctggacggaggcggctatgaggggaaatacatccttcagtccttcggaacctcggagctgggcggaaagctgctggcagagggcgccaatattgaggcggacatggtgaccatgagttccttttatctggacagcgcccaggagaccaaccatatgtttcaggatttgacgtttgagacgaaatccctggcggagtacccggcattttacacgcccatcaccgcccaggaggggacgatcctggtcaatacccaggttttgaaggagaacaatctgcccatgcccacctgcatccgcgatctggcggacccggcgtacgcggggctggtgtctgtgaccgacgtcaaaagttcttccaccgcctggctgctgattcaggcgctggtcagcgcttacggggaggaaggggccgaagaggtgttggccggaatctacgaaaatgcaggggatcacattgagagctccggttccgcgccgctgaaaaaggtgcgggccggcgaggtggccgttggcttcgggctgcggcatcaggcggtggccgataaggagagcggacttccggtggactatgcggacccggcggagggcaatttttccctgaccgaatctgtggcagtgatcgacaagggggagaagagcaacccgctggcgatggagatggcggagtgcatcatcaaaaacggcaggccggagttgctgaaaacctaccccctggcagtgtacgagggcgagaacggcgattccgcaaacaagtccgcttaccccatggtgttcccggagaagctgacggtgcagctgttggaaaaacaccagcagatttcggagaacgcaaaggcgggagcgcagtaggaaatctgcgggcaggagcgtccccgcggctgccgggcaatcgatacaaaacaagcggtgacggcccacttatgagccgaatcacaaaatattatgaagcgaggaaccgatcgatatgataaactataagttattaaccccaggccctctgaccaccacggagacggtaaaacgggaaatgatggtggaccactgtacctgggacgacgattacaagcagatcacccagtggattcgcagaaagctgcttaagctggctggggtggacgaacaggaatacacggctgtgctgatgcagggcagcggaacctttggcgtggagtcggtgctgaccagcgcggtaggttgggaggatcatcttctgattgcggccaacggcgcttatggactgcgcatggccgagatcgccaggcaggccggactctccttttcggtgtacgagacaaactacgacgagataccggacgccggggtgatcgggcggatgctcgcggagaacccgcggatcacccatgtggccatggtccacagcgagaccacatccgggattttgaacgacattgaagctgtgagccgggcggtgaaggctgcgggccggaccatgatcgtggacgccatgtccagctttggcggcgtggagattccggtgggggagtggggcatcgacttcataatcagcagcgccaacaagtgtatccagggcgttccgggcttctcctttatcgtgtgcaggcgggaggcgctggaaatgtgccgcggcagggctagaagcctttcactggacctgtacggacagtggaaatgtatggagctggacggcaaatggcgttatacctcgcccacccatgtggtcctggcctttgcccaggccatccgggagctggaagcggagggaggaatcgcggcgcgccacaggcgttacgcggagaacaaccgtctgctgatttgcggcctgaaggagctgggttttcgtccctacgttggggaggaacaccaggggcccatcatcaccacctttttctacccggagggaaaaaattacgattttcaggaaatgtacggctatatcaaggagcggggctacgccatctatccgggcaaggtgacggatgccgagaccttccgggtgggcaatatcggagaaatttatccccgggatatggaaatattgtgcgggattctggctgactttttgcaggagaaaggatgtttaagagaatgaaatatgaagcagtgatttttgattgggcgggcaccacagtggactacggatgctttgctccggtgcagacctttgtggaagtgtttcaggactatggcatccggccgaccgtggaggagaccagaaagccgatgggcatgttgaaatgggaccacattaaggccatgctggggatggagcgcatccgcagtgagtttgtaaaacggtacgggagagaaccggagaatcgtgatgtggacgcccttcacagccggttcacggaaaaacttctgaaggtgctggatcagttctcagaacccaaggactatgtgtgtgagaccgtggctgcgctgcgggctgcgggcatccgcattggctccaccaccggttacacggacgagatgatggcgattgtggcaagggaagcaaaaaaggcaggttatgagccggactgtatgtttacccccgactccaccgggcatatggggcggccctatccctatatgatcttttgcaacatggaggcattgcaggttacttccgtggctgcggtgatgaaagtgggggataccatctccgatattctggaggccaaaaacgccggggtgacggcggtggggatcgtggagggaagttccgaactggggttgtcccgcgcggagtgggaagcgctatccgggacggcacgggaggcccttgcccgggaggtggagaagcgctaccgggatgccggcgcggattacgtgatcgcggatatccgcggggtgctggaatgtgttgcagattcaactctgtaaagctgcgccgtgggatgcgtccgactggtttcgcctgtcccgtaacgaccaaccaccattaaaatcttccttttcgtccgattgagagcgggacaggattcagagcagcgccggaggcgcgggcggtgaattctgtcccgcttttgggtggtgataaaagctggctgaaggtgcgcgctgccggggaacccggcagaggcgtgatgctaagcggaaagggaccggtttaacttgagaaccgtgatggtagcggtgccctcggtgctggtgacattgctgttgtatgtcagggaaaagcgggtttccgccggaacttcgatgatgatcgagttggacccgtacgcggaggttaaattcgtacctgtcttaaagtagataccgtattcaatgtgcgaggcatcgttgtagtatggcgtgatctgcatatagccgggcgccgccataagggcggatacgtggtaggaaatcagataatatccgggagccagagtgatccgcgtggtgtcggtcagaacaatctgcccagtgggatctgcagtgaccgtcccaagcgggatttgagctgcgtccgtaaactgaacggcaaaggtcgcaaaggcggcgaacacatcgtccggggctgcgccggtggctccggtgggtccgatcggaccggttacgccgtcagcgccggttggaccaatcgcgccggttggcccggtcgcgccggtcggtccagtcgcgccggtcggtccggttgcgccggtcggtccgttggcgccggttggcccagtcgcgccggtcggcccggtcgcgccggttggtccgttggcaccggttggcccggtcgcgccggttggtccggtcgcgccggttggtccgttagcgccagtgggcccgttggcgccggttggcccggtcgcgccggttggtccggttgccccagttggtccgttagcgccggttggtccggtcgcgccggttggcccggtggccccagttggcccggttggcccgttgactccggctgagccggtgggcccggtcggccccgtagccccgtttatccccgccggcccggtggccccgactgcgcccgcagcgcccgtaggtccggctggtccggttgcgcccgtaggtccgttggctccagttgcgccggtaacgcccgcaggtccggcggctccggtgggtccggtgggccccatagctccgtttaacccattggcgccggctggtccggtggccccggtgggtccgatgggccccacggctccgttggctccattagcgccagtcggcccggtgggtccggcaggtccggcggctccggtgggcccggtggggcccatgattccgttggttccggctggcccggttgcgccggttgctccagtaggccctggcggcccctcaattccggtgggcccggtaggtcccatggccccattgctcccggccggcccggtcgctccggtggccccggtcggtccggtgggccccacagctccattcagtccgtcggcgccggctggtcccgtagcccccgtgggtccggtggccccatctgcgcccgcgggtccggtagccccggcgggccccatcggccctgccgggccggttggtcccatagctccattggttcccggagcgcccgtaggtccggttggtcccatggccccgttcgtcccgtttatcccgtcggctccggctggccccgtgggcccggttggtcccatggctccgtttcgcccgggcagaccggccggtcctgtagctccggtggagccggtcggtccggtgggccccacatacccctgagggcccatggcacccgttggtccgggccttccctgaggccccgccggtccggttggtccggggcatccccttggtcctgccggtccggttggcccggggcgtcccattggtcccatcggcccgggtcttccctgaggtcccgccgggcccatgggtcctgcggggccgcgtccgcagcagcgggggcagcagcgggacccgccggggcagcagcagtccggctgtggaagattgtcagatgaatttatgcggttgaaattgcagttgtacatgaccgagtctccttattccacattcaccatatgacctgcgccagagggcagagtggtatcccgtgaatgttcatatacagtaccatatgaagaaaatacggattttgtgaggaagtgatctgcgagaagcagaaaacccagataccgcattgttcccattcccgtcctttccggggcgcttcgcaggccgcggtacggaccacggcggacaactggcagaaaccgtgcgtttgaaattgactgtactgtgaaatgagtctataatgaagctaattcgtattggtccgggcggtctgcgccgcgtccggcccggcagcaggagaacgcggaccggcaggcagatgtcccattggccaattctgaaatatcatatcccggggatggaaatgaggggggttatggaattcaacagtgagagcagagataccagaatctatatcgtggacgatcactatcggatcgtctactttaatcatgcgctgggggaagtgtttccgtcccttaaaacgggcgaactgtgctatcgggcgctatgcggggagtccgctccctgttccgactgcccgttgggccaggaggatggcagcgacagcattttttacaaccagctggtggaccagtgggtggaggtcaataccggccggatcgattggcccggcgagggccgctgccatgctgtttttgcccgcaaaatacaggagggcaaccggaatctgttcttcaatctgaccagcacctcggcctatgacgtgctgtttgaaatgaatctgacccgcgatatgttcaaagtcctctatcaggtggaggggaaatacaatctgccgtcctttattgggcgattggctgagggcgtggagattgcggcgcggattctggtccacccggacgaccgggaggtgttccgcaagttctggagtctggaaagtctgctgtcccgtctggcgtcagagtcgaaagacaatatgctcagagggcaattccggagcaaacgggcggacggctcctactgctgggtggtccagaccgtggttccggtgcgtcatgggggaaacggcgacaagatcgtcatgtgtttcatacaggatatcgatgagcagaaacagcgcgagctggagttgcggaggaatttccacctgcaggacacgaatgtggatcccctgaccggcgtataccggcgggctatatttttccgggaggcggaagcgtttttaaaacaggcgggcccggaaccctactgtctcatggctgtggacatcgaacatttcaagctctttaacgagtggtacgggcaggaggccggggacagctttctggtgaatttcggaacctttctcagggaagaacagcaggccagcggcgggattgccgggtatatgggcggggacgatttcgggattatcctgccggaccgtcttgaagtgctggaacggctccagaacaagatgatccgctacgccaaggagcggggcggcaacgccggattccagccggcctttggcattttccctatcgcggaccggggcatatcggtcagcacaatgtacgaccgggccgtgatcgcgctgggggagatgaagggaaattatgcccgcaggtcctgccgctacgattcgcggatgaagcggaaaatggaagaaaaccacatgctcctttccgaggtgcagcgcgccctggagcaggacgaattcacattttacgcccagcccaagtgcaatatggctacgggaaaaatcatcggcctggagtccctggtgcgctggaaccacccggagcgcgggctgatcgcccccggggattttctgccgttattggaagaaaatgggtttatttccaacctggaccggtatatttgggacaaggtctgttttcgtctgaagaattggattcaaaatggacaccgcccggtgccgatctcggtcaatgtatcgcgggtggacgtgtatgccctggatgtggtgaaggagttaaatgagctgacggaccggtacggcctggacccgcggctgctggaggtggagatcacggagagcgcctacgcggaggacacgacggcggtggccgctgtggtggaagggctcagaaccgcaggttttaccgtgcttatggatgatttcggcagcggctactcctccctgaatatgttaaaggatgtcaatgtggacgtgctcaaaattgacatgaagttcctggatatggacgagcagagcgtgggcaagggcgtgggaattctggaagccatcaccaatatggcccgcctcatggggctgcgcctgatcgccgagggagtggagacccgggagcaggtggatttcctgctcaacctgggctgtatttacgggcaggggtactatttttaccgccccatgcccgttgcggatttggaggcgcggctgtcggacgagcggaatgtggatttccgcgggttgacggctccgggggtggagcgcctcagcctggatgagcttctgcgcggcggcgtggccagtgatattctgatcaacaacattctgggcggcgtggccttctacgacgtgtgcggcgaccagattgaactcacccgggccaatgtgcagtattacaaggtgacgcggacgaaccctgtggatctggaggaataccggagaacaattctggaggggatttacgaggaggaccgcccggctgcggtggatattttccggcgcgcgcgtctggacccgttaaacggagcggagggggatatacgccgtctttgcgagggggagggcacgatctggatgcatctgcgggcattcttcctgcgggagcagggagggcaccagattttctacggagcggtcagcgacgtgacggaacaaaggcggagggagcagaagctggaagcctcccagcgggcgctggcctcggcggtccgtaccgcggaagacgacgagggtttcaaggcgatgaccgaggacaaccgccgcgccgccgcggccattttcgcccagatggctccgggcggcctgatcggcgggtattgcgaggaaggatttccgctgtattttgccaaccaggagatggtcgggctgttgggataccagtcctttgcggaattctcggaggcgatccggggcagggtgatcaataccattcatcccgacgaccggctgcgtgtgatggaggatatcggcgatacgaacaaaccgggaacagaatacatgaccacttaccgcatgatgaaaaagaacggcggatggttctgggcgctggacaagggcaaggtggttctgaccggggacggacgtccggcgatcatcagcgcctgcgcggatatttccgagcctatggcggctcagaaggcgctggcggaacacaaccgggtgattatccggcagaaccaggagctgcatttcctgaacaatgaaacgccgggcggctatcactgctgtgagaatgaccgcggcctcacttttatgtatatcagtaaccgttttttgggaattcttggttacagcgcagaggaaatcaaggcgcggtttgacaataaaatgatgaacatgattcatccggacgaccgggagcgggtgagggctgctgcgtgccagatggagaagaacggcgggaccactgatctggaataccggatcaagggcgcggacggctatatctgggcggcggatcagagccggtatattcgggaggggagccgggggtatgtgcacggcgtggtgctggatatcaccgcgctcaagcagaaggagtatgagctgtgggtgtctggcaagcggacggagagcatcctcaaacaggccgggctcaactgctgggactgggattttgaaaagaatacgctggttctgaccaatgtggtgcagaatgtggaaatgatcggcacttaccagtgtttccgcagcggcgtggttacggtgacggattttccggagcgggtctttgcggacttctgtctgcaggaatccggccgggagagataccgcaggtttgtggaggaagtgcgaagcggagaaaactgcgagagccatacctgcgaggtcccggttcgcgtccgcggagggaaaacggtctgggtccgggtgggctgcgagacgatccgggacgaggagggcagacccgtccgggcggtgggctattacacggatgtcacaaaacagaagaatgaggccctgtgccgggaggaacagctgaagaccctggagcttctgcgcagccaggcgacctatgatttccaggtaaatctgaccagggacatgattctgagcggcgaagggcgggagaaatggatgagggaggcggacgtgccggacggaagctataccgagtccgtcgcctatctgaacaacaatctggtgacgcctgagtttcaggccgccgcggccaagtttatggaccgcgaccggctgctgggcctgtaccgggcggggatttacacagacagcctggagtaccgccggatctacaaaaaccaggtgcgatggatgaaggcggtcatgtacctgatgcagatcggggaccgcccggacgtgtattcctgtatttttgtcatggatatcgacgagcagaagagccaggagctgaagctgagaaagctggcggccacggattccctcaccgggctttacaaccggcagagcggagtggcgcgtatccgcgagtatctttgcagcatggaggaggacgagacggcggcgttgatcatgctggatctggacgacttcaaggtggccaacgacgtgttcggtcacgcctgcggggaccggatcatcgcggagaacgccgccaagttaaaacggcttttccgggaaaaggacgtggtatgccgcatcggcggcgacgaatttctggttctgtgcaaacagatccggcaggaagatgcggataggaagatggacttcattgtccgctccatgaaaagcatctgcagccatggcgaccgggaaatcctgttctccgtgtccgtgggctacgccatgacgccggaccaggggagggattttgacgagctgtaccggaaagcggacatcgcgctgtttgcggcaaagatggacggaaaaggcagatataagctctatgaaccgtccatgaaggcggttcgatatgaattggcggacagggattaacctgcccgccatttttcctaccccaaaaccggattacaggtccagcttcaggtcgccgggtttgatccagccgattttgcgcaggatttcgccgaagataaaggtcagcaccgcggggagcacgaagcagaccatcaggatgccgagccacatgttggcgccgccgcccatggcggtaaacacgccgatggggccgaccagaccgcaggtgcccatgccggaaccggtggggatgttttccagccggaacaccatggtggcgacggggccggtgatcatggaagccagcgtgggcgggatccagatgcggggattgagcacaatgttgcccatctgcagcatgctggtgcccaggccctgggccatcaggccgccgatacggttttcgcggtagctcatgactgcgaagccgatcatctgcgcgcagcagcctgcggttgcggcgccgcccgccaggccgtccagggagagggcgatgcagatggccgcgctgctgatgggaagggtcagagccacgccgatcagagcggacaccaggattcccataaagaagggctgcatctccgtggcggttttcaccactgtgccgaaccagtccataaaccgggccacggtggggccaacgcactgcgccgtcagcacgccgaaaatgatggtgactccgggagtgacgacgatatccagccgcgtttccttggacactagcttgcccagctcagtggccaccaccgtagccaccagcgcgcccaccggtccgcccagggtgttgcccgcgatgcccaccgttgcggcggagaagagcaccagctgtggcgcttttaaagcgtgggcgatggcaactcccagagccgcgcccgtggcgcttttggcgtactgggcgatcacgttgaagctctcgatatgtagctgctgccccagggtgtcgaagatggttccgatgagcagcgaggcgaaaagtccgaaggccatagcgcccagagcgtcgatgagataggcctgaacggtgaagttcacgttcttctttttgaggaattccttgaagtttgacatgatgttacgctccctttagatttattttcgaagaatttttcgtaattgttagggattttaccatagttttagaaaaaagcaaggtttttgtaaaaaaatgcctgatattgataaaaaattaacaatatcaaggacttgggcgcaggctgcgatgtggatgaaagcggggagaccgcggtgggccgccttgcattttaaacgcccgtagtatataatgggaaaaataatggaacgctgtttttaggaaggatgaggctgtcaaacgatggagtttgaactattgtatatgatccagaagctgcatacgccgtttctggatgaggttatgaaagggatcacgtttctgggggagagcggatggttctggattctgctggccgtcctgttattctacccaaaacggaccaggaaaatcggcttggcggtggcgctctccctggccgtggggcttctgctgggaaatatgattctaaagccgctggtcgccaggcagcggccctgctggctggacgggtccattccccttctgatcgccagtccgagggatttttcattcccgtccggacacacgttggccagctttgagggcgcggtgagcattttcctgtaccgcagggactgggggctgtgggccctggcgctggcggtgctgatcgcgttctcgcggctgtatctgttcgtgcactttcccacggatgtgctggcgggagccgtgatgggaacagcgatcgccctgggcgtgcaccggctgctggagcggacggaaaaacgccggaaaaatcaggaagaggtgagaatatgattgagcgcgcaccgggaattttcgaggtggagctgcacagcgggcagctgagcatcagcgagattaagatatttattgtcaagggaacggaaagcggacggagcctgatggtggacgcgggcttccgcaaccgggactgcctgcgggtgatggagggagtgcttgaggagctggggatccgttacgaccagctggacatttttctgacccacaagcaccacgaccactgcgggctggccagcgtgtacgcggagcggggagccaggctgtttttgaaccgtctggaggaccgtcactgttacgactgcctgtattacagccacagccacggggctgcggaggatcagcctcaggttctgcgcagcgtgggcgtgaccccgcaggacacgcccgaggtctgggagatgttcatggagatcaaccggcgggccgagggggagaagggctgggagttcgatattccgggtttctactacaccccggcatcggcgggggatgtgttctgctatgggaattaccggtttgaggcggtggagctctccggccacacttacggacagcttgggctgtatgatgcggacaaaaaggtgctgtttatcgcggaccaggtgatcaacgggatcgtgcctattgtggggaccagctacccggacgaggggcttttggcccggtattttaagtccctggaatacatcaagcaccattacacggactgcctggtgctgccggcccacaacggcccggtgacggatctggcggggacggtgaaccggatcgtgttctcctacctggacaaggcggatatgatccgcagcatcctggtccacggccgcagggccatgaccacccaggaggtggcgcggctggcctacgggatggagcgcgtgcccgcggaccaggcccagttcatcaagctgaaaatggtgatctccaagacgttctcctgcctggaatatctctacgaggaggacttcgcgcttcggacggagcgggacggagtgttttattgggaggcgccgtaaagcaaccgtctgaacggttacggaaattttacttgcatattttttaatatcgtgtatagttatagtcaggcgaagggcggacctctcccggtccgcctttgtcaaaattaaatatggaaatgcagagtaggtttatgcgcgttaagtgccggctgaacagggagttgtcagctggacgaaaagggaatcatcccttgcggtgcgtaggccgcatcccgctgcaacagggatagtgtatcattatctcctattgtagtacgagaggtctgcaaaggaggtaatttttttatgaagaaattagcaactttgttcacccggtccctacaggaattcaagcaggtaaaaaccgtcacggtgtgcgccatgatgggggccgtcgcgctggtgctgggcagtctttccgtggaaatcatcccctcggtgcggatcggattttccggtatccccaatgagtttgtggcctggctgttcggcccggtggtagggccgctgttcaacggcaccatggatatcctgaaatacctggcgaaacccaccaacgcctatttcccggggctgaccatggtcaccatgctggccgggtgcatttacggctgcttcttctacggccgccccatgcgcctgtggcgggtattggcggcaaaattcacggtggcgttgatctgcaacgtgatcctcaataccttttgcctgtccattcttctgggaaagggattctggctgttgcttccgcccagaattctgcgcaacgtgatcatgtggcccatcgattccctgatatttttttatctggccaaattcatggaaacagcgggcgtgcttcggcaatttggcttaaagcccgccctggaaaaggggcaaaaaaacggcgggaagcgttaaaaagctgacgggctgttcctcaaaaagtgcagaaaaatggggctttgcgtgttgcagagcccctgtctgcgtgctatgatgcgactgaacaaaaatgaaacagtcagaagctcatagaggaggaaacgcaaacatggcagtacatgtaatcgacgaggcaaaccgctgcctccagtgtaaaaaaccaatgtgccagcaggggtgccccatccacacgcccataccggcgatcataaaagcgatgcgggagggacgcctggaggaggccggaaaaattgcctttgagaacaaccccatgtccctggtctgctccctggtctgcaaccacgagcgccagtgcgaaggccactgcgttttaggccgcaaaggccagcccatccacgtgagcagcatcgaaaactatatatccgacacctgtttcgagcgcatcgacgtccactgcgctccgaaaaacgggaaaaaggtcgctgtgatcggcgcagggcccgcgggcatcaccatcgccatccttctgaccaagaagggctacagcgtgaccattttcgactcccgggacaagatcggcggcgtgctccagtacggaatcccggaattccgtctgcccaagaccatcctggagcgctacaagaaaaagctgcgcgccatgggcatcaagatccgccccaacaccaccatcggcggagccctggagatcaaggacctgttccgggacggctaccagagcattttcatcggaaccggcgtgtggcgcccaaagaagctgggcatcaagggcgaatccctcggcaacgtccactttgccatcgactatctggccaaccccgacgcctacgagctgggggacaaggtagcggtgatcggcgtgggcaactcggccatggacgtagccagaacggtgatccgccacggctcccgggacgtgaccctttacgcccgcggcgcccgctccgacgccagcctccacgaaacccagtacgccatgctggacggagccaaatttgaattcggcaaacagatcattgaaatcaacgacgacggcccggtattccgaagcatttacagcgatgagaacggaaatattaccggctatgaggagaacaccgagcaggtacatgcggactccgtgattatttccatcagccagggccccaagagcaagcttgtgaacaccacggaaggcttaaaagccaccgaaaacggccttctggagacaaatgaaaacggcgagaccacggtggaaggcatctttgcctccggcgacgtggtcttaggcgccaagacggtggtggaggcggtggcctactccaagatcgtggccgacgccatggaccgttacatgcagaaaaaggagagcagaacagatgaagattaatgcaggaatgcgctgtcacgacatttgcccgaaaatggagctggaggagcttttcggccaggtaaaggccgcaggcgtcacccagatccaactggccatgtccaaatccatttccaactacaactttgaccccggccactacagcgccggcttcgctcgccatatccgttcccttttgcaggaaaacggaatccacgtagcggttctgggctgctacatcaacccggtgaaccccatcgaatcccagcggcaggcagaggtggcccgtttcatcgagcatttaaaatacgcccgcgtgatgggagcggacatggtaggcaccgagaccggccgcctggacccggacatggccgtcacgcccgagacctacaccgaggaagcttaccagctcctgctaaagagcatgagagagatcgtatccgccgcggagaagctgggcgtgatcgtgggcgtggagggcgtattcgaccacacgctgtacagtccggcgcggatgaagcgtttcctggaggacatcgactcccccaacgtggaggtaatcctggacgccgtcaacctgatcggcccagactccgtctcccccgagtcccagcgccgggccgtggagaaagccttcgcctactacggcgaccgcatcggagccctccacatgaaagatttcgtctacgagaacggaatccagcagttccggcatgtaggggaaggcgacttctgtttcgagctgctcctcaaactggtcaaacagcaaaagccccatattgcgatgctactggaaaactccagccgggagcggtatcatggggatgtggaatatctgcaaagcatttttaacagggtgggctgaaagggacggccatggcgggggaggggttcggcggctagggtgtgtttgaaaattcatttccaccatctgcacgccccacttcgcggcatatttggtcccaattcggtcaacgtagcccgctacgcctccctcatcgggaccaaatctcccacaaagtgtgacgcacatctggcggaaagcaatttccaaacacaccctagctccgggaagtcatgttgctaaggtcccgacagcacaaaagaaggggtaccgtggacattcacagcgtattcctgaaggaatacgctgtgaatgtccactcaaaagcttgcattgaggcaagcttttgcccccttcttttgcactgccggtacctaagcaccattgactcccctccacacgcccccaaacccctcccccgccatggcctggcatttccggctgtaagggaaaaatgctcccacaacgcactccccaataaagaaaaaagctcttggcttgcttttgggaataaattgtaaaaatctctggcaaaggcagtacctgtcacaagcaggcggctcctaagccagagatttttttacctcaaggaaaagcgagggaacaggtaatcgagaaaacgtagtgggtgagaggcaggggggcggggattgaggcgactttggagcggttcggagcgtcttaggtccaaggagccgggaaagccgggattgcgcagggcgttcagcgcccggagcaaagcgcaggcggaggggccggcatcaggccggcgccggagctcggagcggtgcccggctttcccggctccttgggccttagacgctcccaccgcggaaaccggagtctcaagccccgcccccctgcctctcacgaacggctgcgcctcaccccaccaccccatcccgtcctttctccgccctctaccccatcatcacaaactccaacaaccgctccatatcctctttctccgatgccacaacatccatttccggtatctcatttccatgggtaaacaccttagccatcgccaaatactgggtcagcttggatttcaggttgagccggtcgccctcgtccgttaccagctccacgcgtcccttacaggaccccactgcctcgaaaaaaccgtcgatgtccttgatatgtctgaatttcatagctcttacctcctggttataattttctgttttcatcttatcaccgccgccccatgaatgcaagatattttggatacatattgactatatttgactaaaaaatgataaaattatatctaaataataaaacaaacaaagcgattaattattgtatgaaataaatatatacataaaatgaaataaatattatcaagaattgatgtttttggttgaaggaccagggggattgtgctatattgaaaatgcatcgggaaacggtggcaaaaaagaagaggaggtagaagatgaacagccaggattatgtcaatgaactatttaatttggaggggcacgtggggattgtgacgggcgcttccaggggattggggatggggatcgcccaggtgctgacaaacgcgggggctacggtctacaatctggatatcatcggacgcagcgacgagaaggagatcaccggaaatatgatcgatatccacgcggacctgaccgaccgggaagcggttcgggagattgtggaccggattgccgcagatgagggacatttggatttcctgatcaacaacgcgggtatcacatacaaatgccgggccgaggaatatcccatggaaaagtacaaacagatccaggacgtgaacctggaatccatatttgagctctgccgtatatgttacccgtacctgaaggaatcccggtacataggaaggattgtgagcatctcctccatggcggcctacatggggcattccggcgtggtcccctactgcatgaccaagtccggggtgaaggggctgaccatcggcctggccgaggagtggaagcaggacaatattctggtcaacagcgtggcgccggggtggttttccaccaagctgaaccaggagatgtaccggaagaacccggaacggcacaaggcggctctggctaaacccatgctgggccggttcggggatccggtggagatcggatatatgatgctgtttcttctgagccggggttccacgtatctgaccggacaggactttgcggtggacggcggcgcgctgtcccacggcttctaaagaggagggcgggagatgatgaaattcagttcaactatgaccatacagtacgacacgattttctctccttttaccgcggcgcagtacccggaggcactggactggcttcgggacagcggatttgacgccgccgaggtgtgcatttcccactaccgggacctggacgtggcgggatttaaggcggagcttgacagacgcgggctggcctgttccaacatttccaccggccaggccaggacgctggagcacatcaccctgctggacgatggggaggcgctggaaagggcgcaggagcgcctgatggagcatatccgggctgcaaagattctggactgcaaggtgacgctggggctgatccgcggtctgggaacgccggggaaggagcgggaggagaggaccctgctggcgcggaacctggagaaggtggtggattacgccgggcagcagcaggtgaagctgattctggaaaccatcaaccgctatgagacggcgctgttcaacaccgtggattcctgtatggattttattgagcgggatctgggcaacccggagtgcgttggcgtgcactgggacgtgtttcacgccaacatcgaggaccgggactttggggaagccattgaccgcatgggggacaggctcatgcacgtgcatctggcggactccaaccgctggttcccggggtacggccatctggatttcccggccattttccggcagctgaaggcggcgggatttgaggattattgttccttcgagtgttttaatctgccgtcgcgggaggccgtgctggcggaggccggccggtttatcggggagatgaaggcggtgatccgttgaagaccacctactttaaaatacacgaggcggacaacgtggtcatcgcgctggaacagcttgtgcccggcagtgagattcagtttacgggcggcagctgcacggctgcggagaccataccaagggggcacaaggtggctctggccgacctggagccgggccaggacgtgatcaagtacggctatcccatcggacgcgccacaaagcgggtacccgcaggctcctgggtgcactcccacaatatgcgcaccaacctggagggcacgctggaatacgagtaccgcccatcctacagcgtgaggacgggagagacggggacgccgggaacagcggtccctgcggaaacggcgccccctgcgcgccaggcgcccgcccccgcgggaccaacgttcaaaggctaccgccgcaaaaacggcgcggtgggggtgcgcaacgagatctggattattcccacggtctcctgtgccaaccacacggcggacgtgctggcaaagctggcttccgtggacttcggcgatgcctgcgacggcatctttgcgtttccgcacaattccggctgctcccagctgggggacgaccaccggatgacacagaagctgctggcggccatcgccaaacaccccaatgcgggcggcgtgctgctggtgagcctgggctgcgagaacaacaatatccacgaatttctccctgttctgggggactacgaccgggatcggttccgggtgctggtcacccaggaggccggggatgagctcggtaccgggctggagcttttgcgggagctggcggagattgtgaagcgggataagcgggtgagggtgccggcgtcggagcttaaaatcgccttcaagtgcggtggttcggattccctgtccggcgtgaccgccaatccgctctgcggcactgtggccgaccggattacctctctgggcggctcggccgtgctgacggaggtgccggaaatgttcggagccgagacgatcctcatgaaccgggccgactcccgggagacctttgaaaaggtggtgaatctgatcaattcctttaaacagtattatctggactacggccagcccgtgtacgagaatccgtccccgggcaacaaggagggcgggatcaccactttggaggagaaatccctgggctgcgtgcagaagggcggccgcgccgtggtgagcgacaccctggactacggggaacagattcgcaggcccggcctgaacctgatgaccgggccgggaaacgacaacgtcagcatcaccgacctggtggcctcgggcgcgcagattctgctgttcaccactggcagggggaatccgctgggcactgccatcccgtgcatcaagctctcgtccaacaccgcgctgtatgagcgcaaacgccactggatcgattttaacgcaggtaccatcgtggacggggattccctggaaaagctgtcggaaaagctgtggaaactggtgctggaggtggcctcgggcaagaaaacccgcagcgagatcaacgggttccgggagatcatgctgtttaaaaacggagtgctgctgtagcgcgcggggcggggcgtccctcgcccgcggcccgcagcgagccatcgtccctgcgctccctcacccgcggcctgtaacgagccatcgtccctgcgctccctcgcccgcggcctgcaacgccgcgcccgcttcacccacaaaaaatcccccgccacccgggcgccacaagaaccgcgcccgctgacgggggatttaataattgcatgggatggatcgccggcgcagcctgatagcgattgattcagccgcattccgatctcattccggcacaagaaccgcgccggacctctcaaccgcgaagccgcggcccctcttatgaatatttcagcataatattgtgctcgctgcaatactgttcgatggccgcatccggcttcttgttggaacagatgatattggccagcgtgaccggtcccagggagatgagggaggtgtgcccgaacttggagtcgtccagcacaaagcagatggtttccgatttctgggtggcggccagcttggtctcccgctccatgggatcgctgtgggagaagccgttggcaagggacatgccggaggccgcgataaacgccttggtgatgttgtagggcgcgaaggcctccttggcgttggtgggggtgaaggaattgttcttcttgttcaggaggccggggaggacgaagaccgtcacgttgtccagggccagggcttttatgatgatgtcgatgttgccggtgatcacggtgatgtttttcaaatggctcacgtaatccagtatatagcaggtggtggagccgctgtccaggtagatgatgtcgttctcctggatgagctgagccgcgtagcggcaggcctccttcttggcctccgtgtttaagctggcccgcaggtggaagggcatgaatttgcgcttgctggtggtgtagacgcagccgtagctcttattgatcgtaccccgctcgcagagcacggtgacggcgcggcgcagcgtgctcatggatatattgaactcattgcacagggcggtcatggacacgttgtcgtgctcctcaacataatcttcaattcgtttcagtttctgctcgttcacaagattctcctttgcataatcaattctaaactatcactatttggttgccatatttttgaaatgtttcctcatattcgtcatttaacggctgatcggtaatcagagtgttaatcctggatgtcgggcaataggtcattaaggtgctgtggccgatcttgctgtggtcggccagcaaaaatatctcctccgccttctgggcggcgatgcttttgattttgtattcctccacggaaaaattcgtggcccccgcgtttagggagaagccgacgcacgagagaaatgccttgagtatgttgtaggttttcatctgctgggaacagctctcgcccgtgaaggacatggtggcccggttgagaatgccgggcagcgtggccagggtaatgttgggctttttgatcacagcattgataatattgacactgtttgtgatgattgtcaagggcaactcatccggaatgtaaaaggggatgaagctggtggtggtcccgttgtcaatatagatgatgtcgtgggcccggatcctggaggccgcgtagcggcagagccgctgcttctcgctgacattctgaatctccggcgcctcggagtaagggtgaaagaccgcgttccccctgggcacggctccggtctccacggtgaccccgccgtaaaccttcttgatgtcgggattcgactccaggatggtggcgatgtagcggcgcacagtgttgatggagacgtcgaagtgatcctgcagctcctttaaggaaatggtctgccggaaccgtatatattcttccatttctaacaattttgcacgtttcatattgtatacccccctgcattatgaattcattatacccaagacatgctcaaaaagcaataagcgaatgtcaaaacccgcgattgtacggccgttggaacatgaaaacgggtatggtgatattggctatatattggaattgttttgataataaaatgataacatagaaagggttgattcgtcaactcactcttttggtataaaaatgatcacaaaaagacgtaaaaataacttgaaataatattaattatgtactatgatgggaagtggtgaaacaaatattatcaaaaaatgaaacaaaattaactaaaaacgtgaaaggagaacatgatgggagaggcaaaaagattgggattctatgcgaacggcgaacacattgtttccaaaactgagaagtatatggacgcatacaatccaagtaccggggaggtaattgcaaaagttccctgctgcacggaggaggaagtggagtacgccatcgcgtgcgctaagcaggcgtatcccggctggtcgtccacgccggtgatcaaacgggtgcagatactctacaagctgcgggacctgctggtggaacatatggacgagctgacctatctggtggcctatgaaaacggaaaggcctgggaggaggccaagggagacgtgctcaaggccaaggaggccacggagcaggcgatttccgctccgtccctgatgatgggcgagagcctgatggacgcctccgcgggttacgacacggttctttaccgggaaccgctgggcgtgtttgccgggatcgtgcccttcaacttcccggccatgatccccatgggctggatgacccctatgtgcatcgcctgcggcaacaccatcgtgctgaaggccgctaccttcacacctcaatcctgcatgcgcatcgcggagctttacaaggaagcggggcttcccgacggcgtgatcaacattgtcacctgctcccgcaccgaggctgaaattttcctcaaccacccggacgtgaagggcatcaccttcgtggggtccaccagcgtgggcaaacacatctacgccacggccgctgcgtccggcaagcgggtccaggccctctgcgaggccaagaaccacgcgctggtgctggaggacgcgccggtggagcggaccgcggccggaatcatcaacgcggccttcggctgcgcgggcgagcgctgcatggccctgccggtggtggtggtgcaggagagcatcgcggacgccctggtggaggccatcgtggagcaggcaaaaaagatcaccgtgggaccggcctacgagaaaaccacggcaatgggaccggtggtgaacgcgggacacaagaagtccgtgctggcctggattgaaaagggcctggaggagggcgccagactggtgctggacggccgtgacgtcaaagttcccggttatgaaaatggattttatatcgggcctacgatttttgaccatgtaaagcccggcatgacggtgggcgattcggaaatcttcgggccggtgctgtgcatcaagcgggttaagacctttgaggaagggctggaggtgatgaatcacaatccatttgccaacggctcggtcatctttacccagaacggccattacgccagagagttcgcgagacacacggacggcggcatggtgggcgtgaacgtgggaatcccggtgccggtgggcgtgttccccttctccggccacaagaattccttcatcggcgatctgcactgcctgggcaaggacggataccgcttctacacggagaccaaggtggtcaccacccgctggttcgacgaggaggagcggaagaaaaagacggtcagcacctgggacgggacgatttaagcgggaaccgcacagagaaaaaccgcacagaaaggaagaaaaatatgagtatcataacatttgattccagccggaagctggatgtaatcccgattgggagaatttgtttggattttaacccggtggagtattttaaaccctggccccagtgcgataatttcaagaagtacgtgggcggctccccggccaatatcgccgtgggaatggcccggctgaactgcaaggtgggctttatcggctgtatctcggacgaccagatgggagatttctgcatccaggtgttcgagggcgagggcatcgacacctccaatatcgtccgggcgcgccacggcgaatccatgggcctggccttcactgaggtgacggatcgggatcactgcgggctgatcatgttccgggaccacgtggcggatctgcagctggagtcctcggacgtgtccgaggcatacataaagagcgcgaaaatgatcgtggtcagcggaacggccctggcggcaagtccctcccgcgaggcggtgctaaaggccatctactacgccaagaagaacgggaccgtcattgtgttcgatatcgactaccggccctatacctggaaaacggacgacgagatcgccatctattactccatggcggccagggaagcggatatcatcatgggctccagggaggagttcgacaagaccgacgccctgctgggccgtgagatgaccgacgaggagatcgctcagaggtggtttggcgagcgggcgaagattgtggtgatcaaacacggcaaacagggctccaccgcctacattcagggcgagggctcctacagcataaggcccttccctgtggacgcggtcaagtccacaggcggcggggacggctatggcagcgcatttttaaacggcctgttaaacggctgggacatcatgcgctgtctggagtacggcagcgcctccgcttccatgctggtggccagccacggctgttctccggatatgccgaagttggaggagatcacggagtttatccgcagggaaaaagaactgtacggggaaatgattgcagttgccaagtgagacggaggagagacatgctgtgcaatttgaaggaggcggcccgcatcgccatagcggaaaacagcgggctgccggcatttaacgtattcggctacgaggacgcggccgctgtgataaacgccgccgagcggatgaaccggccggtggtgctgatgaccaacaaggtggccgtggcccatatggggattccggtgctggctgggatgctcttagagatggccaggcggtccgaggtgcccacctgcgtgcacttggaccacgctacggagcttgcggacatccgccaggcggtggacagcggttacacgtccgtgatgatcgacggctcccagcttccctttgacgagaacgttgcggtcacccgggctgcggtggagatcgccaggcccaggggggtgagcgtggaggcggagatcggctctgtgggctacagcgacaacgcggacgccaaacgccggttcacggaccccggggaggcggagcgctttgctgcgcttaccggggtggacgccctggcggtggcggtgggaacggtgcaccgcatggagacccagggggtggatttgcagtttgacctgctgcgccgcatccgccaggtggtgaagattccccttgtgatccatggctccaccggcgtggcggaccgggatctgcgccgcctgatcgagtgcggggcggtgaagatcaacatgggcaccaccctgcgcatggtgttcggccagacgctccgggaacagattgaggagaatccaaaactgttcgatcgagtagaaatgtatcaaaaatgtatgaaagctgtagaaggaaaagctattgagaaaataaaatgcctttgaaaagtagaagataatcaaaagttgctcaaaattattaaaaaagataaagttttgttaaaattgttgacgaacactcgcaaagttgctataatcgtaaacatagaaaatgcacaaaataaaaagaggatcaaacatataacaataaaaaatgaccaaaaagagggatgaaatgaaggcgcttgtgattgaccttggcagcagctttgtaaagtctgcaatacttgatcttgaaaatgggaaacttttgagtcaaaaaaagaccatatattcgtcaaaaagaagatacgacgacaagctcctcttcgaggtgccggtccggtccatcgtggatacggtgaaggagcttctggatcaggggaccagggaacacggcgatctgacctccctccttctgtccacccagatgcacggttttgtctaccggaccgggcagacgccggatcccgtctacgtgtcctggcaggacatgaggtgcctgcaccaaaagtctccggggctcacgtacctggaatatctgcaggggctgttttccaaggaggatatggaggactgcggcgtgtacatcaagccttccctggggctgtgcaacctgtacaccatgctggaggagaatcccggcctggaccggaacggcaccctttatacccttggatcctacgtcatagagcagctgaccgggaacaatatctgccacatcaccaacgccgctcctttgggcctggtggatgtcaggcggcgttgctggtcggagaaggttctgcgcaaagcaggatttgaggggatcagacttccgcagctggcgccgtcggattttgcctcctgcggcagctgcacggtgaacggccggacggtttcggtctacccggattacggcgaccagcagatcgcggtgctgggttccatgccagagctgggggacggcctgatcaatatcgccacggcagggcaggtgtccatggtctccgatgtgtttgaaccgggggagtacgagatccggccctactttgacggacgggtgctccggaccatttccaatatgccctccggccgagggttggacgtgctggtgcgatttattgccgaaagcacagagcttctgaccggagtccaggtgagcgtgggggagttctggtccgcctttgaaaagcagtttgtggagggggatcaggggatcgcggtggatatgagcttttacgccactccccggaagctggacggcggcgagattcgggggatcacccagaataacctgaacgtcaataccctgttctcggcggctttccgggatatggcggagacgtattggagaaatctggtaattcttgccggcagcgaacccatagagcgggtggtgtgttccggcggcgtgtcctggaaacggccggagttgatccgtatgatcggccgggtggccggacggtcctgccgtctgtcggccctggacgacgaggccatggccgggctttaccggatggccctctgctgcaacggaatctgccgggggctggacgacaaaagggaaatgatcctgcgcctgtgaaggcccggacctgccgggcgggatgatagcccggatgagagagaacagaaggggtgagagagtgaagacagtaaaagagaagatcagagaccgggagccggtgttcggcaccatgatatcggagatggcctgccccaatctggcccggatttttaaggcggccgggtttgcctacatgattgtggactgtgagcacggatatttcgactattcccagctggcggccatggtttcggtggcaaacggcgcagggatcggcgcggtggtgcgcattcccaccattgaccggggggtgatcaccaaggtactggacatgggggcggacggactgttggttcccatggtgaacacagcggatgaggccaggcagattgtatcctatgccaagtacccgcctctgggacaccggggggcgtccacccagcgggcccataccaattacgacccgccgaagcttgaggaatattttgagatcgccaacgccagaaccattattctggcacagatcgagacccggcaggccctggaccatgtgggcgagatcgccgcggtggagggaatcgacgcggtggtgatcgggcccaacgacctgtccatcgacttgggcgtcccgggggacctgggagctccggccatgaaggaggcgcagcgcattgtggcggaggccgccgcgcaggcgggcaaggcttcgggtatgatcacctcccgcacggatgtgatccgggattgccgggacggcggtatgacggttttgagctgcgacagcgaggtaggaatgcttcttaaaatggcgcggaaggtaatgggcgagctgcaggcgtgagcaggttgaaaaggctgcggcggacttacataacgggtattacatcaaacgaaagtcgggtgaagagatgcttgatgtgacaaaaaacaatctggtgacaagattctgtggggacgtggagctgccgcccatgtacagaatccggcagaagttcgacgcctcccacatcggggaggaggagctgccgtcggtgatccgcggggagcttgaccggatgggagatcagatccggcccgggatgcggatcggaatcacctcgggtagccggggggtggccaatgtggctctgatcaccaaatgtattgcagattttttgaaggaaaaaggggcggatccctttgtatttccggccatgggcagccacggaggcgccacggccgagggccagcgggagatcatcgaatcctacggcgtgacggaagaatacgtgggctgtcccattctctcctccatggagacggtggaggtggggaaacggcccgacggcaagccggtgtttgtggacaagaacgcttttgaggcggacggcatcgtgctctgcggccggatcaaggcccacacggccttccgcggcccctacgagagcggcctcatgaaaatggccgtgatcggcatgggcaagcagcacggggccgagcaggttcacgagtcgggcttccataatatgggaaagcttatgccccaggtggcccgggtggtttttgacaacacgaagattctgttcggtctgggcctcatcgagaatgcctttgaccagacctgcaaggtgcgggcgctgctgcccgatgagatttgggcgcaggagccggaactgttaaaggacgccaagggccggatgggccggctgctgttggacaatctggacgtgctggtggtggaccgcatcggcaaggatatcagcggggacggcatggaccccaacgtcacggggcggttcgcctgcgctaagtcggccagcggcgggatcaacacccagcgcatcgtggttttgggcctgacggaggccagccaccacaatgccaacggcatcggcatggcggacgtgaccaccaggcggcttgcggcggacacggacctggatgccacctatcccaacgcggtgacgtccacggtgctggacgtggtgaagatccccttcgtggcggagaatgatcagacggccatccggctgggcgttcggacctgcaacgagatcgaccgggaacgcccccggatcgtgcggattcaggataccatgcatttggaagaaattgaaatctcggaggccctgttgggggaggcccaggcggaacccgatatcgagatcgtgggaggcccttatccctgggcttttgacgaaaatggaaacttgtggtgatttaccaacgcgtaattaaaataaaacgaattgaaggaggaaatggtatgaagaaaatgagaagaggttttgcgctggcgatggcatccgccatggtgctgctgaccgcatgcggcggcagtcagggagcgtccggctctgcggctcctgcggacacccaggcgacccaggccccggaggcgggtaaggataccggcgcggccgccgataccaccgcggctgcggcaagcggagacgtgatcaagatcggctgtccccagcccctgaccggaaccaacgccctggtaggagataccaccgtgaaggcggcccagctggcggttaaacagatcaacgagcagggcggactgttgggcagacaggtagagctggtggtttacgacgaccaggcgtcccccgaggaggcggtaaagatcgccaccaagctgatcgaggtggacaaggtggacgtggtctgcggttctctgatcagcagctgcgtgctggcctccggacagttctttgaggaagcgaagattccctgtatcggaacgggattaagctccacctggatgaagcagggctgggaatatgtgttccgcgcctgccccaacgccggaatgggcatgcccgctctggctgagtacatgaagaacctgggaatcaccaagatcgccatcttccagggccaggacgactcctccgcctccggcgcagaggatatgagaaacgcctgcaaggacgcgggaatcgaagtgctgacctccgagacgtatgtggaaggcgacacggactattccggccagatcgccaagatcttaaacagcaatccccaggccgtatttacctccaccttctccccgactcaggctccctttgcaaaacagctgagacagttcggatatgagggcctggtatttaacaaagagaccctgtccatggataacatcaaggtggccggcgacgccggaaacggatactgcttcatgttcccctacgtgacctacaacagcgtggatgagattcaggatcccatgatgaaggacttcagccaggcgtactttgacgagtacgacgccatgccttaccacgactgcgcatacagagcttacgactccatcatggtgctgaaaaaagccgttgagatcgcaggcagcaccgacggcgaggcggttaagaacgccattctgaccatcaaggatttcgagactctgggcggcattcaggactttacccagggcgacggcgagggcatgcacctggagaacttcaaaccgtggatcgtttggggcggacttcagatcgacttaaacgagtggttaaagaccgacgactggaccgctatgaaagcgaaaatggggctctaattgaacgcagcaacaacatccgaataattggttgaacatggggaaggcgggttgaggtaactcgccttttcccaaaaaaacttctgttgagagggggaaaccgcttctatgctatttcagattatcatttcaggcctggtgatcggcagcgtttacgggctgattgcactgggatacagcctgatttacaaatcgtccggcctcatgagctttgtgcagggcgatatgctgactttcggcgctttcttgggttacacgttttacggggttttgggaattccgtttttcatttccttcttcatggttattttcctgatgttcctcttgggctttgccatcgagaaaggcgtgattcaccgcctggtggccaagggggtcaaccccatctataccgtgctggctaccatcgccatttcctatattatccagaacggttccatggtgctgttcgggtcggacatcaaatacttcccgccggttacatcaatcaagaacataaagatcctcagcctgagcgtgcagaccgaggcggcgctctgtatcatcgcttccgttatctttatgattctgttcaacttcttcatgaataagacaagccacggaacggccatgcgggccgccaccatggacccaatggcggcaagggcctgcggcatcgacgtcgggtttaccaccgggctttcctgggccatcgcctccggtatcgccggttttgccgggatgctgatcggtccggtgtacggcgtgtacaccacggtgggggcggtgatcggacgtaaaggcttcagcagcgccgtaatgggcggcttcggaaatatgttgggagccatcgtgggcggcgtgctcctgggactgattgagacatttctgtccgcctatgtatcttcggcgcataaagatatcatcgcttattccattctgctgatcttcttgtttgtgaagccgaccggtatctttaatgaacgcgcaatcgctgactgataggaggaaggtatgaataagacaatttcgaaaaaaaatctcatcattttgggagtgattctggtcgcctttccgtttgtcgccgacaagatgtttaactggaactacggtgtgcttctggcaaacttcgccattctgtacataatcgcggtgtccggactggatatcctgttcggatactcggggcagatttccatgggccatgcggccttctactgtatcggcgcctacggctccgtgctgatccaccagttcaccgggctgcccgtgatcgtcaccatcctgatgggaacggtgatcgccaccctgatcggcgccctgctggcctacccggcttccaagctggtgttccacttcctgtccctggcgaccatcgccttcggcgaggtggtctaccagctggtggcccagtctccgggaaatattaccggcaactttaccggaaagttcacggacacgatctctctgtttggatttaagctgaattcctatacgaaatactattatttttccatgatctgtatggtgatcttcctcgtgatcaaggtcaacctggtacattccagggtgggacgggcgttcatcgccatccgtgagaactcccacgcggccaacggaatgggaatcaacgtgcgcaagtacaaggtcatcgcctttgccaccagcgcattttacacggcctttgccggcgggctttacgcgcatctggtgcgcttcatcagcccggataccttcaccaacaagcagtccgtcatgttcctgaccatgctgctgttcggcggcagtgcctccgtgggcggaaccgtgaccggcgtgtttacggtccagttcttaaacgagatcctgcgctccgcagagcgctaccagctgctcatctacggcatccttctgctgctggtaatcctggcgttcccgggcggcttatacgggctgatcaagcaagtgatcgcaaagattaaatcgaagaagggggagaaggcaaatgctgcaagttgatcatcttaccttgaaatttggcggattaattgcaaacaacgacgtatccatgcaggtccaggagggcaagatcaccgggctgatcggccccaacggagccggaaagaccacctttttcaactccatcagcggcgtgtataagcccaccagcggcaccatcaccttccggggcaagcgcatcgacggcctgcagccctaccagattaaccagatgggcatgtccaggacctaccaggttatcaacctgttcaagaaaatgagcgtggtggaaaacgtgatggtggggatgcacccccacatgaagcaggggtattttgcctcggccttcaagaccgccgcggagcgccgggaggaacgggagtgctacgagcgggcctacgagctgctggatttcgtggggcttaagggcagggcctttgagcaggccggttccctctcctacggccagcagcgccacttagagatcgtgcgcggcctggccagcaatcccaagctgattctgcttgacgagccggccgcgggcatgaactccaaggagaaggaggagttaaacgagctgttgtaccgcatcatcgaccggggcgtgtccattctgatcatcgagcacgacatgaagctgatgatgggcgtggcggactacctgtacgtgcttaactacggcaagctgctggcggagggcaccacctccgagattcagacgaatccggaagtgatcaaggcatatttgggaggtgacgaataggatgggagcactgctggaagtaaaggattttcattattattacggaaatatccatgtggtgaagggcattaacctgaaggtggacaagggcgagatcgtgaccctgatcggggccaacggagccggcaaaaccacaacgctgcagtccatttccgggctaacgcccgctgcgggcgtccggggcgagatcatttacaagggcacgccgatccagaagatgcacggaaacaagattctgcgcatgggactgtcccaggtgctcgagggacggcatatcttctccaagctgtcggtgtacgaaaacctgatgatgggagcgtacacccgcaaggacaaggcggggattcaggaggatttgaagcgcgtctacaacctgttcccaagactggaggagcggcgggaacagatgggcggcaccctttccggcggcgagcagcagatgcttgccatcggccgggccatggtggcaaagacggagcttatgcttctggacgagccttccctgggactggcgcccatcgtgatcaaggagattttcgaggcggtgctcaagatccgtgaggagggcaccacgatcctgttcgtggagcagaactccaagatcgcgctcaacaccgcggaccggggttatgtgatgcagaccggcgagatcatcatggaggacacctgcgccaatctgctgcagaacgaggaagtgaagaaagcatatctgggcggttcataagagccgccgataaaaataaagggggtaattcaaaatgggatacaaggtattgctggcgcaggacgtgtcggagtccggcaaggagctgcttaaggagaacggctgcgaggtgattctggccccgcgggaggatccggaggtcatgaaggagctgatcaaagactgcgacgcctgcttttccaagacatttttcttctccgaggacattttgaaggaggggaagaagcttcaggtggtgtccaagcacggcgtgggcgtggacaacgtggtggatgtggccactgccaccagacttggcctttacgtggtgcgcacgcccctcgccaatatggattccgtggctgagcacaccctgggggcgatcctggccatggccaagaacatgctgcccctggagaaggcggcccgcaaggcggatttcgacgcgccgctgtcgtttgagagccacgacatcgggggaaagaccctgggtatcattggactgggaaatattggaagaaccttggcgaaaaaggcacacggcggctttgatatggagattctgggctacgatccctttgtgaaaaaggaggacctgccggactatatcacctgtgtggaggatgtggacgatatcttccgccgggcggactatgtgagcctgcacttaaatgcttcgccggagaacgacaatttcgtggataagaggcggctggagctgatgaagcccggcgcatgcctgctgaacttctcccggggctccaatgtgaacgaggcggatttgtacgaagcgctgaaaaaccgcgtgatcgccggggcggctctggacgtgttcgcccaggagccggtgcgggcggacaatccgcttttaagcctggacaacgtggtgctctcaccccactgtgcggcgctgaccgtggaagccatggaccggatgagctaccagggctgtcagggcatcgtggagatactgaagggagagaagcccacctggtgcatgaactacgaggaagtccgcgcgatgagagaaaagggatgagccatgcagaaattattacaaattcgtgaggaggatgcggtggccgtggccctggcgcccatcgcggccggcgagaccgtctccttcgggccgggcaaaatcgtgacggccagggaaatggtccgccagggccacaagatcgccctgcggcccatcccggcgggaacggatgtgatcaagtacggctgctccatcggcggggccactgcggatattgaggcggggcagtgggtgcacacccacaacatgaagagcaatttgaccgagcacgtggagtacgcctacgagccggacgttaagccccttgcgccctgcgaaccggagacctttatgggctaccggcgggaggacggccgggcgggaatccgcaatgaaatctggatcattcccggcgtgggctgcgtggacgatctgtgtatgcgcctggccgtggagaaccaggagctggtggagcgctttggactggacgggctttacgccttcccccaccccttcgggtgcagccagctgggcgaggacaatgagatgaccaggcagcttctggcctccctggcaaaccaccccaacgcgggggcggtactggtggtcagcctgggctgcgagaacaacgtgcccgcggagtttaaagaggccgttttccgaaccgcgggggacggcttcagcccggaccgggtgaagtttctggtctgccaggaggtggaggacgaggttgcggagggcagccgcctgctggtcaggctggcggagtacgcgggacagtttaagcgaagccccatccccgcaagcgagctggtgatcgggatgaaatgcggcggcagcgacggcctgtccggcgtcacggccaacccggtgctgggtcgggcgggggacatgctggtggccagaggcggcagcaccatgatcaccgaggtgccggagatgttcggcgcggagcagatgctgctgcaccggtgcgtcagccgggaggttttcgacaaggcccaggccatgctcaacgattaccgggattatttcgtgcgcaacgggcagccggtgtacggcaatccggccccgggcaattacgaggggggaatcagctccctggaggacaagagctgcggctgcgtgcagaagggcgggagcgcgccgatcgaggacgtgattccctacgcggggcagatccgcaagaaagggcttacgctgcttgccggacctggcagcgatctggtctcggccaccaacctgacggccgccggggcccacatcgtgatctttaccaccggccggggcacgccctacagcaccgccgcgcccaccatcaaggtgtccaccaacacgccgctgtacgagaagaaaaagggctggatggattttaacgccggggtggttgccgaaggcatgcccatcggggacgcggctgcggagctttaccggcagattctgcgggtggccggtggggaacagaccaagggcgaggccatgggttaccgccgcatcgcgattttcaagaacggggttatcgtatgatggaatcgattcataaatatttccggctgggaaccttgagttggatgagctttccgacggaccggtacgatccggtggacgccgtccggcatatcgccagggacggggatttggacgcggtggagatcacggattacaaggacccggaggtgaagaagcagatccggcatatcctgaaccagtcccatttgtcggtggcctacggggcacagcccgtgatccttggagagaatttaaatcccaacagcctggacgagccggaacggagaatggcccaggagcgcctgctggaagccatggaggacgccaagagcttcggggcctcgggattttcctttatggccggagcctggtgccgggaggggaaagaggaggcgctctcgcagctcaagaagacggccagggccctgtgcagccgcggcagcagtctgggaatggcggtggagctggaggtctttgacttcgacctggacaagaaagtgctcatcggccccgcgcctctggcggcccggtttgccgctgagatgcgccaggtgacgaacaatttcgggctgctggcggacctgtcccatttcccgaccacctatgaggacagcgcctttgcggtgcgggccatgcggccctacctgacccatttccacatcggaaacgcggtggtgacgccggagaaggacgcctacggggacaaacatcccagattcggctatccccacggggccaacgatgtgggggagctttatgattttttcaccgtactccggcaggagggattttttaacagcagaaatcccgtcatgctgtccgccgaggtgacgccccggcccggcgaggaggcggagattgtgcttgcaaatacgaaacgggtgattaacagggcctggtctgtgctgtaggaggctgactttggggaggaatcgaatgaagatcattatattggacggatatacggagaacccgggggacttaagctgggatggattttcggccctgggtgacttgacggtttacgaccggacgccgccggaggccgtggcggagcgcatcgggggcgcgcagatcgtgctgaccaacaagacgcccgtcactcgggagacgctggagcgctgcccggggatccgctacatcggcgtgctggcaacgggctacaatatcgtggatattgacgctgcccgggagcgggggatcgcggtgtccaatatccccgcctacggcaccgcggcggtggcccagttcgtgttcgcgctgatgctggaactttgccaccacgtgggggagcacagccgggccgttgcggccggggagtgggagcgctgcccggacttctgcttctggaactaccccctgatcgagcttgccgggaaaacattgggactggtgggctgcggccgcatcggccgggcggtggcggggatcggccgggccttcggcatggaggtcatcggctatgacaagttcccggcggagtgcccggatctgacctgtgtgtccctggaagaggtgtaccggcggtcggatttcatttccctgcactgtccgctccttgcggacaaccgggggatgataaacgacgagagcatcgggaaaatgaaggacggggtctatctgatcaatacatccagagggccgctcatcgacgagaccgccctgcgccgggccctggattcgggaaaggtggcgggggccggtctggatgtggtggagacagagccgatccggggcgataacccgctgctgggcgcaaaaaactgcctgatcacgccccacatcgcctgggcggcgaagagcagcaggcagcggttgatggatattgcagtggaaaatctgagcgcgtttctggagggctgtccggtcaaccaggtgaacgcctgacaagggggaatgaagtcatggagagattgtcatacaaaacattggaaaaacttgggtttgagggatatctcatgccggagggcacggagcgggtgctgcagttcggcgagggaaatttcctgcgggcctttgtggactattttatcgatctggccaacgagcggaccggctggggaaccaaggtagtggtggctcagcccatcgcccagggcagaagcgaggacatcaaccgccaggacgggctttacaccgtatacctgagggggctggaaaacggggagcaggtgatccgcaaacgggtggtcagttccatcagccgggctttaaacccctacgaggattacggcgcgcttctggcctgcgcggccaatcccgatctgcgctacattgtcagcaacaccaccgaggcgggcatcgcgttcgatgaaaattcacggttcgacgaggagccgccggggtcatttccggccaagctcacccggttcctctacgagcgctactcctgcttcaagggggaggcgggcaagggactggtgattctgtcctgcgagctgatcgaccacaacggcgacgagctgaagcgctgcgtgggccaatacaccgaactgtggaagctggagccggaatttgccggatggcttgaccgggaggtgattttctgctccaccatggtggaccgcatcgtcaccggttaccccagggccgaggcggagactttgaacgctcagaacggttacgaggaccttctgctggacaccggcgaggtgttcgccatctgggtgatcgaggggcccaaggagctggaggacgagctgcccttcaagaaggcggggctgccggtgatcgtggcggaggactgcacgccctataagaagcgcaaggtccgcatgctcaacggcgtccagaccaccatggtgctggcctcctacctatcgggccaggacatcgtgcgaaaatgcatggaggacccggccatctactccttcatggaacgctgcgtctacgacgagatcatcccggtgctgaccgagtacccgaaggaggagctggaagactacgcggcgggcctgttcgaccggctgtgcaatccctttatcgaccacagcctgctggccatctccttaaacaccacgtccaagtggaaggccagggttctgcccacggtcagggagtaccaggccgccacgggcgggctgccgcccaggctgacggccgggttcgcggcttacgtgatgttctaccggggagagcgtttggaggaaaatgccctggtggcccatcggggagagacggagtaccggatctgcgacgacatggaggtactgcgcttctttgaggcccataagagcgacagcccggtggagctggccggggccgtgtgccggaatgaagccttttggggcggggaccttacggaaattccgggctttttggaactggtaaccgaatatctgcagctgtttgagcgggagggcgtccaccgcgtgtttgagctgctgggcaactgatgaaggaaggagagaagcggatgaaatcgattgtgatcaaccagccgggccaggtggtgttccgggaggacccaatgccggttgcgaaggagggcgaggccctgttaaagctgctctacggcggaatttgcggaagcgatttgggttcctaccgcggaacctacgcgtattttgattatcccaggataccgggtcacgagttttccgccgagatcgtggaggtgggggaaaatgactacggtctggaaaagggcatgatcgtcacctgtaacccctatttcaactgcacccactgctattcctgccgccggggcctggtgaactgctgcaccaccaaccagaccatgggctgtcagcgggacggcgctttttccgagtacatcgcaatgccccttgagcgcatttatgacggcaagggcgtgccgcccaaaaccctggcgctgatcgaacccttctgcatcagctaccacggcgtttcccgtgccaatattaagcccggggaccgggtactggtactgggagcgggtaccatcggcgtgctggccgcggtggcggccaaggccaagggagccagggtctatgtggcggacgtggctgagaaaaaacttcagtttgccatggacagcttcggcctggaggggacgctgctcaacgactcgccggagcatttccgggagcaggtggaggatgtcacgggcggcgacggattcgacgtgaccatcgaggcggtgggcctgccctccaccttccagaactgcatcgacgcggcggccttcggcggaaacgtggtgctcattggcatcggtaagaagaacctggacttcaacttcaccaccatccagaagaaggagctgaacgtgttcggctcccgcaacgccctgaaggcggattttctggagctcatcgacctggtgaaggccgggggcgtggacctggagaagattgtgaccaacgtgtacaggtttgcggacgcgccggaagccttcgcggaatttgaccgcagggctggggaaatgcttaaggtggtgctggactttacataaggcttgggttgtgccggaaataaattggataaaactggaaatgcataaaaaaccggacagggtccgcggaaacggcgcgggttctgcccggtttttttgcgcatccgagggatggggacgaggttacaaatatgttaagaaatgccaaaaatggttccggttttgtaacctcagtagtatactatagacaaataatattgggtatatgtgggtgggaatcctgcattacccctaaggaggtcaggtatatgatatcgtttcttggaggacttgtactgctgattgccggttattttctttacggcagctttgtggagcgggtgttccacccggacagccggcagacccctgcctacgccatggaggacgatgtggactttgtgcccatgtccaccagccgggcgtttttggttcagcttctgaacatcgcggggcttggccccattttcggagcgctcagcggggcgctgtgggggccggtggtctacatctggattgtgctcggcactattttcgcagggggcgtccacgactatctctccggtatgctctccgagcgcaacaacggcgcgtccatctcagagatcgtaggcaaatacctgggtccggtcatggcggtggtcatgcggatcttctcggtgattctgctggtgatggtgggcgttgtgtttatggtaggcccggcggggttgatcgcgctgttgacgccggaggccctgaacgtacagttctggacgattgtgattctgatctactatttcctggcgacgctgctgcccatcgacaagatcatcggcaagctgtacccgattttcggcatctgcctgatcgtcatggcgcttggcatcgcgggagctacgctgtattacagcggcacaagacctatgctggagatttgggaccatgtggaaaacatgtatcccggcaaggagcttccgatctggcccctgatgtgcatcaccgtggcctgcggcgccatttccggcttccacgccacccagtcgcccatgatggcccgctgtatcaagagcgagaaggaaggccgcaaggtgttctacggagccatggtagcggagggcgttatcgccctgatctgggcttccgcgggtatcgccttctattatgaccgggcgggcgccggcacggggcttcaggctctgctggccgccaagggcggaaattccaccacggtttacgacatgtccatccagcttttgggcggcgttggcggcgtgctggccatgctgggcgtgatcgcctgtcccatcacctccggcgacacggcgttccgctccgcgcgtctgaccatcgcggactggttcaagatcgatcagaaggacaccaagaagcgcctgatgctctcggttcccttactcctggtgggatacggcatctccttcctggactataacaccatctggcggtatttctcctggtccaaccagaccctggccatgatggcgctgtgggcggcagccacctacgtgtgccgtttcgtgggcaagaattacggctggatcgcggcggtcccggccacctatatgacctcggtgagcgtcgcctatatcctgcaggcccaggagggcttccgcctccccgccgccctgtccaacggagtgggcatctgcgcggcggttgtgtgcctgacgctgtacgtggtaaaagtgtacgtgaaatccgaggtgaagtccaccagaaaggacgaggcgctggtgatcaagtagctttccccgtcagctgcgctgatagaactctttaaagacctgtataaattcccgcagggcgttggacagatagcggcctttgggaaggatcaggtcgaagtggcggacagcctgacaggagtcgattttatagtacaatgtgtccggtccggggtcggtgaccagaatgtcgctgataaaggcggctcccaggccgccccgggccagatggtaggcggtgaccagctgggccaccttcagccggacgacgggggtgatccctgcggctgcaaaaaagtgtttgctgcgggcgtgaaggttgttgccctcggtcagcaatataaagggggtatccccaaaggcttcaaggcgtatggaagggcaggacaattccatatgcctttttttcagcacatcctccccggtcagggcgaaatcccgcaggacgacgttcaccttataggaggcgggcaccgccagcagcacgatgtcctggaaaacgggatggcggtcgaaatcgtcctcgtacagcgggttgcagctgaaggtggtgtcgatgacccggtcctttaacaggcccagcagctcgtaggagccggcctccaccagctccaggcggatgcccgggtggcgtccggcgtaggccgtcagcaccggcggcagcacgtaggagttgaaatagtgggagccgccgatgcagatggaaccggtgtttaagcccgacaggtcgtgaaactgctgcttcatctcgtcctccagggcctggaactgacggaccttgcggatgtagatttccccggcctcggtcagcttgagcggctggcggttccggtcaaagagcggcattccgatctcagcctccaccttctggaccgcgatgcttaaggccggctgggtcaggtacagggctgccgctgctttggaaaagctgcctttctggtataccgtatagatgtatttcatttcctgatgcatagaatcccctttcggattgtgtggcgtttatccctataaattaatttaatggctttataaatactataaaattgattttataacatctttaacataaaattaatatgacaaaaataacgaatttctcgagaaaaaatcgttatttttcactatgtgccggcatagagggatcagcaacgcaacaagtcgcatgtatttcatgcaaatccaatcaagaaaaggggattcttatgagtatcattaagaaatggaatggcttgagtttgtttacgcggattatggtaggttttgtgctggggattctctgcggcctggtgatgggaccccaggctaagatgtttaactttttggggaccattctggtccgtcttctgaccatggtggtggcgccgctggtgctgtgcctgctggtctgcgcggccgccgacgtgggcgactaccgaacattgggaaagatcggcctgaagacggtggtgatcttcctggtgagcaccggcttcgctatttttatcggcctggtgatggccaatctgatcaatgtgggaacgggcgtgaatattgagattcccaaggaggcggaggagtcctcggtggtgattcccagcgctctggacaccctgatcaatattatcccgaaaaacccctttgaggcgctgagcacccagaatctgttacagatcatcttcttcgcgctgttcttcggcttcgctctgatcaaactgggcgacaagggcgccgtggtgttaaacttcttccgcggctgcacggacgccatgaaggagatcacctccatcgtgctggaattcaccccttacggcgtgttcggcctgatggcaaacgtggtgggcaccaacggcctgggaattctgcttccctatatgaagacgattctggcggtttacgtggcctccgccctgtttaccgtgctggtgcaggcgggcctgatggtgggcgtcggcgctcacatgagcccggttaagttcttaaaaggcgtgaaggaagccgccatgttcgtgttcgcaacctgcagcagcgttgccacgatcccggtgaacttaaagtgtgtgaagaaactgggcgtcagcgacgagatcgcaaacttcgtgatccccttcggcgctgtgatgaacatgaacggaacggcgatctacgaggcggtggcggttatctttacggctcaggtgtacggcattgagctgaccctcatgcagcagatcatggtcatgctcaccgctaccctggcttccgtgggaaccgcgggcgtgcccggatccggcctggtgatgctgaccattgtgctcagctccgtgaacctgcccatggaggccatcggattgctggccggtatcgaccgcatcctgaacatgggccgcgtgatccccaatatcgtgggcgacgcagccaccgcagtgctggtagccaagaccgagggcgcattggccgacgtgccggagagcgccgcaaacgcttagaaatgtgaggaggagtatatggaaaccggaaaaatcaacgcgctgataatggaggagaccgacaatgtggtgacctgcgtcatggagatcaaaaagggagacgccgtagtttaccgcaagggagatacatactgtaccgtggaggcgctggaggacattccctactgccacaagatcgccctaatcccctttgacgagggggacgaggtggtcaagtacggcgagatgatcgggagaaccaaccgggctatcggcaaagggtgcctggtaaaccatgagaatatctacagcgtacccagagattacgagagcgagatggtgtgaggaggagcgatatggaatttttaggatacagaaggtcggacggaagagtggggatccgcaaccatgtgctgattctcccggcctgcgcctgcggaagcgagagctgccgggtggtggcgagccaggtgcgcggagccgtgaacattatttttaacacgggctgctccgatgtggcggcgaacacggccatgtcccagaaggtgctgaccggattcgccttaaatcccaacgtctacggcgtggtgatcatcggtctgggctgcgagaccgtccctcacagggaactgcgggagaaaatacaggcccttaccgacaagccggtggcctccttcggaatccaggaggagggcggcaccttaaagaccatcgagaaggcggtgcgggccgcacgggacatggcggcggcggcttccaggcagcagcgggttccctgcgacatctcggagctgctcatgggcattgagtgcggcggttcggacgccacctcgggcatcgcctccaaccctgcggtgggcgagctcagtgatcttttggtggatgcgggcgcttccaccatgatgagcgagaccatcgagttcatcggcggcgagcacgtgctggcaaagcgcggagccacccctgagattcacaaccggatcattcagatctgcaaggagtacgaggagcacctggcgggagcgggccagaactgccgggcgggccagcccaccccgggcaacaaggccggagggctttccaccctggacgagaagagtctgggctgcatccgcaagggcggcacccgtccggtggtggaggtggtggagcaggccgcccggcctaccaaaaagggcgccatcatcatggacacggcgggctacgatatttcctccgtcacctccatggtggcgggcggctgccaggccatcgtgttcaccaccggccggggcacccccacgggcaacgccatcgtcccggtgatcaaggtcacgggcaacaagctgacctaccagcgcatggaggacaacatggacgtggacgtcagcggcatcgtggacggcgcctgcaccatcagggagagcggaaaacagctcttcgacgaattccttgaggtgtgcaacggcaagatgaccaaggcggaggcctacgggttctccgatatcgcggtggatcatgtgtgccggtttgtgtagtgtgggttttgagagagattgagtgaggaaacagaaacgaggaaaagctggtgggagatgggttcccatcagcttttttgagtgtgaggggccgcgtgcgccggctgagggcggttgccgggaaaaccgggtagtcaaaccttccgggatatggtaaagttgtgtttatgagaacaggaaagggaggacacggttatgaccgcagaggaattcagaaaaaagctggaggaggatgaggagtgggcaccgggctgggaggccattgagagcgtctttgagaagctgtacccggaccgggagccgtcccattacggcaccaatatggcagcccgggccatgttcggcggggattgctacctggacgggtattccatctacgattcccccaacggctacaagcacatcgtcaccttcggcatgacggagctgtacgccgacgaggacgccctgggcggcgagtggaacaactgggggtatgagatgaccatcaagctggcggagacggacaatgagagctgcatgtgggccatcggcatgctcagcaatctggcgtactacacctataccgagaagcggtttttcgaacccttccagtttatcgcaggggacggcggctccatcaaccgggaccgggattctcagatcaccgccctgatgacggtgtacgacacggaggcccggggcgtggacaccatctacggcaggacggattttatccagctggtgggcatcaccgagcgggaactggatctgctgaaggcggaccgggaaaacgcccgggtgctgtacgagcggatgcgggcggaaaatccgcatttggtgacggatttgaatcggacgaaatcgtatttgtagggcttgcgtggggccggtccctcgcctcagccgcccagctcccgcttcagtttgcggaaggaaaccacaaacagagccaccgtggtgcacacggccacggcgtccgcgatgggctcggccaggaacacggccatgaccttgttctcaaagaaccggggcaggagatagatgagcggaatcagcaaaaataccttgcgcagcagggccagaaacaggctggtcttgctgtcccccagggagatgaaggtctgctggcaggcgatctgcgcgccgaacatcagggaggccgccatgtagattctcaaggcccagacggcgtatccggtcagggcctggtcctgggtgaaaatgccggtgaacacgtgagggaaaaacatagccacggaccacagcacggtggcgtaacccagacaggtgacgagcagcaggcggaaggcggagtccacccggtggatttttctggcgccgtagttgaagctgataatgggctgggcgccctggcacatgcccatgaggggcagcagggagaactgcatcacgctgctgcagatggtcatggaccccaccgcgatgtcgccgccgtagcgctgcagggaggtgttgaagcagatgtttaagatgctctccgtaaactgcatcacaaagggggccgcgcccagggcgatggcgggcatcagcacggacttttccaccttcaggcaggggatgcggatctttaaatagctcttgccggacaccaggaacatgaccacaaaggccgcgctgattccctgggaaatgatggtggccagggctgccccccggacgcccatgtgcagcacgaacatgagaatggggtccaggataatgttgcagactgcgccgatgagcacggtcagcatgccggttcgggcgtacccctgggcgttgatgaacgcgtttaagccgagggccagctggacgaagatggtgccgatggagtaaatctgcatatagctccaggcatattcgatggtgtcgccgctggcgccgaaggttaagaggattctttggccgaacagctgaatgaccgcggtcaggatcagcgataccgcgatcagagccgtggtgcagtttccgaggatcttctcagcctcgtccctgcggcctttgcccagcatgatggaggccctgggagccccgcccatgctgaccagggccgcaaatgcggagatggccatgatgatggggaaggtgacgcccacgccggtcagagcgctggcgcccacatccggcaggtggccgatgtacatgcggtccaccatattatagagaacattgatgacctgggccgagatagcgggaagcgccaggctgaacaaaagctttccgacactgccggatccgagatccacctcttttacatttttctgatccgccataaataacacgtcctttcacaagtgataaataagtgtgaataataatcatttaataactataacgcgaagagaagggaaagtcaatgatatgatcaaggcaatcttttttgacatcgatggaacgctgagggatttcgaggagaaaggcataccggagtacacccgcagggccctggatatggcccgtgaggcgggactgcggctgtgcatcgccacggggcgccattggctggaaatcgaggaggaagggcttttgggggatctggaatttgacgcttacgtgacgctcaacgggcagctctgctatgtgcgcgagggacgggagcttccggggcgggccatttataaaaatcccattgatccggggcaggcgagacgccttttggggatgattgaggaggagccgtttccctgcctgtttatggaggaggggagaatgtatatcaattatacggacccgcgggtggagctggtgcagcagggaatcggcaccgcgctgccgccggtgggagacatcgggcgggcgctggagaatccggtgtatcagattgtgccttatgtggatgcgaagcgggccggagagattatcgcgggccttccgggctgcggccatgccatgtggcatgcgggaaatgcggtggatctgctgccctttgggggaggaaaatgcggggggattgagaagacgctggagtatttcgggatgaaggcggaggaagcggcggctgtgggggacgggaagaatgacgtgtcgatgctggcgtatgtgggagtgggggttgcaatgggaaatgggtgtgaggaggcgaagcgggcagcagattttgtggtggagaggattgagagagaggggcttttggaagcagttgaaggaattttgaggcggtgagataaaatcgaacggacagagttttgggagcggcacacaggtattttcctggagccgctcctggttttatcctctctgacgtctgcggcgcccaccgccgcggcgcttgaaaaagcggaggaaatggcggtctgccatgggacggttaccccccagccaatgcggaggcggccctgcgggagctgcatagacgggcgttgcccctatccccgatttggcccgcccagacggcacaccgcccgcccctgtccggcgtccaatatcaggcaggccctgttgccgctgaggtcgtagagctttacaatgtcggtcagctccgtctcgccgggcaggagggcttttaagacctccgggtagcgctgcagcagctcgggctgatacaggcgggtgttgcggttgtcgttgatggccccatagtagacgtcggcctccaccagatcctggaacatatggcttccgtaggacagctccggatggtagcctgcgtccttgtacgccacctcgcagatggcgttaaactggctgatttccgcgtaggacaccggcacgccaagttccggggaagaggtgccgatgcggccgggaaccagcagcatgagctttttgtcgaccgtctcaaaataccggttgatccgcccgatcaaccgggccacgtccgtctttttcgcgtagggatactcgtaatatttccgggggtccagccacacgatgtagtcgatcagctccgtcttggagcggcgcatggtggtctggcgcacgtcgaagagcagattgtcgtccacgccggtggggatgtgcacctgctccgacgcggcggactgcagggggcggcactggagcaggttcagcttccaggtattttcctcgggacaggtgacggcaaattccacatccaccggacattcatacttggattccagcatctgcagcatggagtacatcatgctgatgaactcgtggttatccacaatgccctgacagtccgcaaaataaacctttttatacacgtgccgctccgccagaaggtcctcggcctcagtgtcccggctcagcaccagcttcttctgccatttgggcagcagctcgatgatttcatccagctttttggtgcaaagctgctttttcgggaagtccaggacgtccacctgccgctgggagtatttgtggcggtccgccagggtggtccgcaggttggcctgagagcggtccagccccactaagcgcggatagtctccgggcgtgcgctccacggcccgggttccgagccccgccaccatgcgcagcatcccggccctgggatttaaatactccatccatttgtagggattgtaggaacagcccatgcctgcggctaccggcagatagtaatccccgtaggtctggccggagacctgctggatcagcagcgccatctgctcatccatgtccagcagatgacgttttctgcggtattcaatggctgattcgttcattacgctggcgtagacgcgccggatggcgtcctccagctctttcaggcgttcttccttagtcccctggttcatgcagaacacggattcgtactttccggagaatgcgtttccgtagccgtcctccatgatactgctggagcgaacaatgatcggcagattgccgtagtggtccagcatctcctccagctgaacccggatctcctccgggatttttccgttctgcagccgccttgtcagctcctccgcctcctggaaatgctccttttccagtttgtgccgggccttcagctcggcgcaccggtttaataccatgtactggtagaacacgtctgtgccgataaaataggagttgtgaggttccatgtgggccgcaagttccggcattttgagcgcgatcagcttgcgggcaaccaaaagcccgcaggccttgccgccgatcactccgctgccgatccggcgcgcgttcaccgcccggaaatccgctgcggtaaagtatttcaaaatcagctgctccatgtggctttccgaagtcatgagcttattgcacacccatttctgctcctccggcgtcaggctttcctgtttcagcatttccgtccagtccgtcatcttatttctcccgtcttatgtattaagttctttataagtaatgtaacgcaaaaatggaccggtggcaagggacatttttacacagggccgtatccctttttccgatggaataccagcagcagacccagatagcagcagcacaggaagccgatttgcagggccgtctcgataaagaggggcagctggccggaggggctggagatgggggtggcgaagcggtaaaggccgatggagatggcgaggagcagggagggttttagaaccatactccaggcgttccagcggaaggggaccaggcgctttagggagagcaggctgaagagcgccagggccagctcgctggccagcattccccagaggtaaccctggatgccgaaaaccgggatggcgaagaggacgaaggccagacggatcagcatggcaagtacgttctggaagaaagtgatggaggttttgccaaggccgtttaagacgcttcccagggtggtggccaggtacatgaaggggcagagccaggccaggatggtgatgaaggcgcccgcgtccgggtcgcgaaagacgctgacgcccagctggtttccgaacatggtaaagacgccgatgcagaggatgcccatgtagcagctgtagcgcagggacatggagatcacggaggagatgcgctcctcgttgccgtcggactgggcctcggccaccgtgggcagcagaagcaccgccatggagttggtgatggcggaggggaagaggatgaagggcaggctcatcccggtcaacacgccgtagacggagaaggcctcgctgtttgtgagcccgaagcgcaccaggcggttgggaatccagatggcttccgcgctgcctaagaagttgagcaccaggcggttgcccatgagggggagggccagggccattaaggggccggaagtgtcgcgcagccctgcggtgagcccgccccagccggcagtctgaaggccggggcgcaggccgcggtccggcgggaacaggagcagggagaggaaggtgaaggcggccgaggccatttccccgatcaggtggccgtagacggccagggtgacggtgatctcccggccccgctccgcccagatatccacgatgaggaataccgccgccatgcggatcacctgctccgccacctgggagaaggccggaacccgggccttctgcatgccgtaatagtagccgttgatgcaggcgtgcagggctgcgaagggcacggacagggccatgacgggcagatagggagcgcagcgcggctccaacagcagcctggcggctaaaaagtcgtcgaaccggcagatgaaggcggccagcaggacggacagggacatggaaatgataaggccgctacggaaggccgcccggccccgcttcatgttggccgccacgtactgggatagggcggtctgaatggaaccggcgcagacggcaaagcagatgccgaacaccgggtggaccatgttgtagatgccaagcccttccgcgccgacggcccgggacatgaagatccggtaaaagaaccccagaacccggcagaggaagccggtcccggtgagcagcagcgtgcccgtaataaatgcccgctttcgcggggacagccagctgcctatggattgtgaggaagtcttgggactgttcatataaactccgggttttgcgaattattataaatatatgggggaggcggtaggttatgacgttttagagaagagaggcggtaggattctccgggagtgtaaacaaaattcgtttactttttgggagagtatggggtataatagtaagaaatactgtgatcagacagactcgatatgaggtgacgcgaattatgttaaaaaggctggaaatcgacaattttaagacgctgaatcgttttgccatggatttttcaccaatgaccgttatcgtcggcaacaatgcttcgggaaaaagcacgatattgcaggtgctgagcatgctttccagctgtgtccaggaagattttccagcattttttgaccgccggggatggaatgtgtcggagctgcgctcgaaatgtaaaggaaagatggacaaggtgctgcgcgtggccgccgaggtggagatcattgtaaatggacggccctgcccgttgagatgggaaatgcagcttcagtatgatttgcagagcaattcgctcttactggtgttcgagcgcgttcaaaatatggaatcggagcaaattctgttggaattctcggaaaagggtggggctttgtttggccgttcggaagatactctttactatccgcagatgattttggaatcttcgttcatgaaggtagctttgaatagtcataccatgggagggatattccctgagttggcggagctgaagcattttttgacaaggatgcgctcgtacgagctgctgtcgccggatcagatgcggaccagcagcagaggaagggcggagtatctgtcgatttccgggaagaatctgccgatctatctgaaaagcttaccggaagagaagaaagatcgtttcctgttgaagttaagaaagctgctgggtgataaaattgagcgggtttccacggagacaaggggtaagccgggttgggtttacatggtggtggaagaaaaatacgaaaaggcgaaataccggatttcatctggacacttgagtgacggcctgctcaggctgctggccatagtggcgatcagtgaaagcaaaaactgcagcatgtccatgctggatgaaatagaaaatgggatcaacagttcctacgcggaagggctgattgggatttttcgggatatgagcggagacggcacccagatggtgctgaccacgcacagcgtcgtatttctggattacgtggaaaaggacgagatcgttttcctataccgctctgagactgacggaagtacaaaagcagtgcgcatatttgatacgccggagctggcagaacggctggaatatatgtatccgggagaaatcatttacaatctgggaaatcaggagctggtggagctctgtatgcaacacatgggataagatagggggattggcgtggcagacgcagtcatcgcagtgacgggagaaggccctacggattacggccatttgatttttgataaaaagaatggtccgcagtgggaatggggaccggttttggatttacttgaaaactgtatgaaggattatgagatagaagacagacccggttttcgccaggtgcgaaaagaagaactgaaggacgtcaaattgcttcggtcagaccgcggcttgaagggcctggcggttccggcccgcaaatttaaaaaatattgttgtggtcaaaaaattgagcacggtatattttacgcagatgcggatgcaaaagatggatcggccaaaaccgctccggaggcgaaaaagtattatcgtgaggtttatcaggcggcggccgccggtttggaaatgggggaggataaaacgttcatccctatgattcctcttaaaatgatcgaaaactggcttctcgcagatgaggaggcatttgagcgtgtttttggtaaaaagccgaaattgccccaaaagccggaattgatatggggtgataaacgcgatccggacagtgattatccgaagaatctcctggaacgggtgctgcaggatgtttcggatgatcaaaacgacagctgccgggaaacgttctgccggttggcaaaggccgccgacatttccgtgttgagaacaaaatgtaagatcagctttgaacggttctatcaggacttcagagaaatgctccaataagtagaagataaaatcgctgtatttcacaggtacagcggttttttttgaaaaatcccccgaaaatccaatccaaaatctgcatatactatatagtggacaaaaaaactccattttagggacaaaataatatcattcccattgaaattgtaggaattaaatggtatagtaagtagcgtagatgaagcttttaactttatgctatgtataaaacaaaatgaaaggcggatttgcaacatgaaacagttgatttatctggacaatgcggccacgaccaagacgcggcccgaggtggtggaggccatgcttccctacttcagcgaatattacgggaatccatcttccgtatacgaattttcaaccatcaccaaaaaggcggtgaccggggcccgcgagaccatcgcgaagtccctgggagccaggaccgaggagatatattttaccgccgggggcagcgagtccgacaactgggcgctgaccgccgctgcggaagcttaccagtccaagggtaagcacatcatcaccagcaagatcgaacaccacgcggtgctgcacacctgcgcccatctggagaagtgtggttttgaggtgacctacgtggacgtggacgagaacggcgtggtcaagctggatgagcttaagaaggccatccggcccgacaccatcctgatctccatcatgttcgccaacaatgagatcggcaccatcgagcccataagggagatcggacagatcgccagagagcacggcatcctgttccacaccgatgcggtgcaggcctacgctcacgttccgatcaatgtggacgagtacaacatcgacatgctcagctccagcgcccacaagttaaacggccccaagggcatcggtttcctctatatccgcaagggcgtgaagatccgctctttcatccacggcggcgcccaggagcgcaagcgccgtgccggcacggaaaatgtacccggtatcgtgggctacggcaaggccgtggagctggccatggccacgctggaggaacgctccaagtatgagaccggcttgcgcgactacctgatggaccgcgtcatggccgagattccctatacccggatcaacggctcccgcaaaaaccgtctgcccaacaacgtgaacttcgcattccagtttatcgagggcgagtccctgctcatcaagctggacatggaaggaatctgcggttccagcggctccgcctgtacctccggctccctggatccctcccacgtgctcttggccatcgggctgccccacgagatcgcccacggctccctgcggctgaccttaagcgaggagaacaccaaagaggagatggattacgtggtggagaagctgaaggagatcgtggcctacctgcgcaacctgtccccgctttacgaggacttcatgaagaaaaacaaccggtaaccgccggttacgggcggcgggggattcccggataacagcgccacgggcggcggggcctccccgcccgctcacaaaacccaaaatacaggagattgaattatgtatacagagaaagtaatggaccattttgagcacccaagaaatgtaggagaaattgaaaatgccagcggcatgggcactgtgggaaatcccaagtgcggcgatatcatgcgcatttacctggatatcgacgagaaccagatcatccgggacgtgaagtttaagaccttcggctgcggcgccgccgtggccaccagcagtatggccacggagttagtcaagggcaaatccatctacgaggccatgcaggtgactaacaaggccgtctgtgaggccctggacggacttccgcccgtaaagatccactgttccctgctggccgaggaggccatccacgcggcgctgtgggattacgcccagaagaacggcatcaccatcgacgggcttgagaaacccaaggacaacatcggcgaagaggaagaagaggaagattattaatcggccatgagtgaagagaaaaagaccgtagtggtgggcatgtccgggggagtggattcctctgtggccgcctaccttttaaaacagcagggttaccgggtgatcggcgtgaccatgcagatctggcaggacgaggacggggacgtgcaggaggaacaggggggctgttgcggcttaagcgccgtggatgacgcccgccgggtggctatgcagctggagatcccttactacgtgatgaatttcaagcaggaattccgcgagcacgtgatggactacttcgcaggggaatatctggagggcagaacgcccaacccctgcatcgcctgcaaccgctatgtgaagtgggagtccctgctgcgccgcagcatcgccatcggggccgactacatcgcaaccggccattacgccaggatcgagcggctggaaaacgggcgtttcgccctgcgccgttccgtcaccgaggccaaggaccagacctacgccctgtacaacctgacccaggagcagctttccagaactctgatgcccgtgggcagctatcacaaggacgagattcggcggatggcagaagagatcggcctcaatgtggcccacaagcccgacagccaggagatctgctttgtgccggacaaggattacgcctcattcattgaggactacaccggcaaatcctgtcccgagggcaatttcgtggatctccatggaaatgttttgggacgccacaaggggatttcccactataccgtgggccagcgcaagggcctgaacctgtctatgggccgccctgtgttcgtggtagagatccgcccggacaccaacgaggtggtgatcggggaaggcgaagatgtatttacaaatattctccgctgtagtaaactgaactggatggcggtggacgggcttcacggcgggcggctgcgggtcgatgcaaagatccgctacagccacagaggcgcggcctgtaccatacgcgagatcggcgaagacctggtggaatgcgtgttcgacgagccggtccgggcggtgacgccgggacaggccgtggtattctacaccggggactacgtggccggaggaggaacgattttatgagacgaacaatgacgaaaatgggcttggcggtgctctgcgcaggcgcgctctgcaccagcggagccctttccgcatgcgggacatacaagccggtggaggcggcctcggatcagacagctgtcggagacggtcaaaaccgggcggacggcggagacggtcaggcagcggcggatagcggagacagccaggctgcggcagatggcgggcaggcggacgggaacacccagcccacccctgagtccagccgcaacgaggcggaattgaccaccgccaagccgccggaattcgacgaggtggatgagacggtctatgtaaaaaccgcggacgggacgccggtaaacgtgcgctccagctgcaacaagcagaacaattccaacgtggtgaccacagcaggcgcgggcgaagagcttaagcgcaccggaatcagcgaggagtggagccgcattgtgatggacggccaggtgtattatgtggccacggcgtttctgaccaccgaggtccccgagaccacggcggcctcgaattccgccaacgtggaggcgggcgaggtgaagctggacgcctcctggaaatacgcggacttttccaagatcaattccggggcggcaaaactgtaccgctccgaggctgaaaaccgcaagaacaagacaatctgcgttaacgcgggccatggcacctcgggcggaagcagcgtaaagacccagtgccatcccgacggcacccccaaggtgacaggcggcaccaccagcgcgggcgctacctcggcggtggcggtgtccggcggcatgacattttccgacggaaccccggaggccaaggtcactctggccatggccctgaagctgaaggacaagctgctggcgaacggctacgacgtgctgatgatccgggagagcgatgatgtccagctggacaacatcgcccgcaccgtgatcgccaacaacaccagcgactgccacattgccctgcactgggacagcaccaccaacaacaagggggctttctacatgagtgtgccctccaaccagtcctaccgaaacatggaaccggtgaagtcccactgggagcagcacaacgccttgggcgccagcctggtagccgggcttaaatccaccggcgtgaagatcttttccaacggagccatggagatggacctgacccagacctccttttccaccatcccttccgtggacatcgagctgggcgataaggcttccgatcactcctccgccaccctggataccctggcggacgggctgctggctgggatcaaccagtatttcggatattaaacattctgaagcggggaagtttgcggcgctgccgcagtgttccctgcgcgcggagtccctgccgttttcccggcaaacgtgttttgcccccgggaaaacggcggaatcccccgggccggaattctgcccgcgggatttcgcgtaaataatcaataaaaatatagaaaaatacagcgaaccacttcccaaaagatgaattttagtgtataatatgatagttggctatttttaggagacgtagcgaagcggccgtaacgcggcgcactcgaaatgcgtttatcggttcatcccggtacgagggttcgaatccctccgtctccgctcgtaaacccttaacccttgactcgttcaagggtttttcgttttttatgaccattgactgcgacacctcggcacgggatacggcaaacttagacggaatggaaacaaagcggcttttgtgttgaataaaaggaggtagaaggatttggggaatgtgacgctggcggaggttgagagcctggcacggaagatactgacgacttatttctgcgactccgatctggagtttttgatttccacatttgcagatgacattatctggctgggcggcggcgagaaacagaaggcggagggaaaagaggcggtggctgcctgcttccggagcggaaaggacggtatgattgcctgtgatatgagcgatgaaacctaccactgcatggacctgggaggcggcgcttacctttgcgagggggtgagctggctgcgcagcaagccgggatcggaattctacatcaatatgcagcagcgggtgacttttgtgttccgtgagacagacgagggtcttaaggccgtacatatccacaattccgtgccctaccaggccattaaggaggacgaactgttcccgatcgagtccagcagggaagaattcatccgcctgcaatcggctctgaacatcaaaaaccaggagtttgagaaccaggcacagtttctggaacgcctgtacaacaccataccctgcggtattcttcagtttaccacggatcccagccacagggtggtggctttaaatcccatgacctggaaattttacggctatgactccgaggaagcgtaccggcgtcatgtgacaagtcctctggacaatgtggaggcggaggaccgcggccgggtcctggcagccatcggccgcctgaccctaaacggcgagaatgtgtcctaccgtcgccgctgcgtccgaagggacggtcaggaggtgtggatcagcgtggtcatgggccggatcgtcaacagcgacggtctggaggtgattcaggcggtatttacggatatcacggagcagatgcgcctggaaaaggcccaggagcaggagcggatcctggaaaaccgttttctgcgcgccgcgatctacaccgcgtatcccctgattatgagcctgaatctgacccgggatacctacagcctgtttgtggatgagcaggattcctacaccattcagggggaggggacctacacggatctggtggagaacagcctgcccatgatctatccctcctaccaggaggattaccggaacaccttccggcgggaggagattctgcgcaggtttgaggccggggagcaagagatctacatggagatgcagcagatcggggacgacggggagtaccactggctctccgtgcacgtgatcgcggtggagaacccctttaacgacgacgtgctggccatcgatctggtgaagcttttggacagtcagcgccaggagcaggcacgccagcagcagctcctgagggatgccctggcctccgcgaacgcggccagcagggccaagtcagatttcctctcccggatgagccacgatatccgcacgcccatgaacgccatcatcggcatgaccaccatcggccaactcaaactggaggataggcaggtggtgcgggactgtttccgcaagattgacacctcatccaagtatctcctgtccctgatcaacgacattttagacatgtccaagatcgagactgacaaaatggagatcgcccacgagctctttgacttcaaatcctttgcggaggagttgaatcagatcatctatccccagaccctggagaaggaggtgggctatgagatgcgccaccgggagcccctggaaagccactatatcggcgactccctgcgcatgaagcagattttggtaaacctgctctccaacgccctgaagttcacccctccgggagggaaaatgggggtggacatccgcgaggagaagcgcgccaacgggttcgtctacctggagtttatggtctgggacaacggcatcggcatgtctgaagaattcatgcagcggatcttccagccctttgagcaggagaacccggggaatgcccgcaacaatgtgggcagcggcctgggtctgtccatcgtctacaatctggtgcagctcatgggcggaaccatcggcgtggagagcaaaaaggacaaaggcagcaccttcaccgtcaccattccctttcagctggtatccgacaaccaggagcgggagtgggagcggaaacggcagaatcttctgaaaggctttgaggtgctggtggtggacgacgatccggaggtgggacggcagacggcggatatcctggaggacattggggccagaaccgtgtgggcggattccggctaccaggccgtggcagaggtggagatgagcctatgccaggaccggatgttcgatatcgccatgatcgactggaaaatgcccgggatcgacgggatcgagacggccaggcggatccgaagcctggtgggggaggataccatgatcatcatgatcacggcctacgactggagcggcatcgaggcggaggcccgggctgcgggcatcgactattttatcgccaagcccctgttccggtccgcgatctacgacacgttctcaaagctggatgagcggaatccggagccgtccgggcactgcgattcgggccttgcagggaaacgtttcctgctggctgaggacaatgagctgaaccgggagattgtggtgacgcttctggaaatgaacggcgcggctgtggacaccgctgtaaacggccaggaggcccttgacatcttcgcggcccgggaaccggggacctacgacgcggttctgatggatatccgtatgccggttatggacggcctggaggcgtgcacacggattcgcgccatggaccgcggggacggcccgtcggttccgattttggccatgaccgccaacgcctttgaagaggacaagcagaaagcgtttgcagcggggatgacgggatacctggtcaagcctctggatatccgcctcctggtggaggaactgaagcgctgcctgggctgaggcgcccaggcggaatcctgcaaaaaagcataagagcgttaaaatgagggaaatggtccggcggccgttttcctcattctgcatcccgggaaaccttcccggacggctccggggcgcgaacccattgggaaagaagaatcttaaaaacctatataaatcatgggtttgcgctgcaatcgggccggttaaaagcattgcacattcaacccttctatgctagaatgaaatggtatatatatggacagagttaagaaactgtttacacaaataatatatgaaatatttctggagtgaccggattcaccgaacgcggggacagtggacgctggcgcggcagttcaggacaaggggataaaacaatgatctataaaacaatattggtggttgaggacaacgagatcaaccggactatgctgaacacgatactggccgatcaatatcaggtgctggaagcggaaaacggggaggaggcgctctccctgctggaacggtacaaggatgagatatccctcattctgctggatttggtgatgcccgtgatggacggctatacctttctgtccatcatgaaatccacgcccgactacgcgaccatcccggtgatcgtcaccacgcagaatgacggcgagaccgacgaggtggcggccctggctcacggggccaccgatttcgtggcaaagccctacaagccccaggtgatcctgcaccgcgtggccagcatcatcaatctgcgggagacggcggccatggtcaaccagttccagtacgaccggctgaccgggctttacagcaaggagtttttctaccggaaggccaaggagctgctggcccagaatccccaaaagcgctacgatgtgatctgctccgacatcgagaatttcaagctgatcaacgacgtgttcgggattccggccggggaccggctgctgtgcggaatcgcccggctctacacccggatggtgaacgggcgcggcctctgcggccggttcaacgcggaccagttcgtgtgcctgctggagcatagctgggaatactccaacgagatgttccggaatgcagagatcgagatcagcgccatgtcaaacaccaggagcgtgtccatgaaatggggcgtgttcgcggttgtggatcggaccattccctttgagcagatgtgcgaccgggcgcttttggccgcccgcagcatcaagggccagtacggaaagtatttcgccacctacgacgacaagctgcgcaacaagctgctgcgggagcaggccatcacggacggcatggaggctgcgctgaaggaaggccagttcgtgatctatctgcagcccaagtaccggattcaggactaccagctggcgggcgcggaggcgctgatccggtggaaccacccggagtggggcttccagtctccggctgagtttatccccctgtttgagaaaaacggtttcatcaccaagctggaccagttcgtgtgggaccggacctgcgccgcgctgcggtcctgggacgacaagggacttccggcaatcgccgtctccgtcaatgtatcccgggcggacatctacaatgcgaacctgacggatttcctcatgaacacggtaaacaagtatgggctgtccccttccaggctccacctggagatcacggagagcgcctacaccgaggaccccaatcagatcatcgagacggtggtcagcctgcgcaatctgggatttatcatcgagatggacgactttggcagcgggtactcgtccctgaacatgctcaatcagatgccgttagatatcctgaaactggatatgaaattcatccagagcgagacggctaaacccaacaagcagggaatcctgcgctttatcatgggcctggcccggtggatgaagctgagcgtggtggcggagggcgtggagaccccggagcagatggagcggctgcgagagatcggctgcgactacgctcagggttactatatggccagacctatgccttgtgaccagtttgaggagctgctgagagagcaggccggaagcggagagcaggcggaggagacggaagaatcgcttcaggaggactgcccccggcagattctgctgatcgcggacgaagatgagacctaccgcggacaggtgcgggagctctttaaagatcagtttgaggtggtggaggcagcggacggcgaggcggccctgggctgcatcgcggactacgagagccggatcggggcggtggtcctgagcctgaccctatcagggccggacggtttctccgtgctggagattttgcagcgggagaaagcggtgtggaacatctgtgccatcgccacggcctcagcggatgcgggtatggaggagcgggccctggagatgggcgccgacgactttaccggcaagccccataccatgaagagcctgaaacgccgggtgacccgggcgctcagagccacgcagacccgggagtggagcctggagcttcagcaggaggccagcagggattatctgaccggactgttaaaccgccgcggatttcaggcggccatggattccctgcgcaaggaggacgctcccctggccctctatctgtttgacctggacaatttgaagtcgatcaacgacaccttcgggcatgcggagggggaccgccatatccggcagtttgctcagcttttgcgctcccacacccgggaatccgatatcctgtcgcgctacggcggggatgaattcgtggtggtgatgaagcagatgaagaccgatgaagccgcgctcaaaaagggcgaggagatttgccgggcgatccgggaaatgggggccggaggaaatctggcggcgtgcacggcgggcgttgtccgccggaatgaaccggattcctcagaggagctgattgaacgggcggaccaggcattataccaggcgaagaaaaacaacaagggcggctgcagtttgtggaggaaatgagccggatgaggagacagatgatagcgattgagacaatacgggagttctgccgggtgtggtttgaggagcgggactggaaaaagacggtggagtatctgacggaggacgtcacctttgtggggaccggggagcatgaatccgccagaggaaaagaggcgatggccgcgtatctccgggaggatattctggagattccggagccctttgacctggattttaccgtgattcaccagcagccgatccgggaggatgtcgtcagtctttcctttgagattgtgctgaagaacacggtgtatatatggcggcttcggtgtttctttaccctggttgaagcggcggagggcgtgtgggagatcgccagcctgcattttgcggagcctggcaacagccagcagggagccgagcactatccccagacgctggtgatccggaacacggtccgccagcgccaggagctgctcaacgattcgctgcccggaggtatgatgggcggttacatagaagacggttttcccttctactttgtcaaccgccagatgctgcgctacctgggttatgagaccgaggcggaatttatcgacgatatagacggcatgatcaccaactgcatgcatccggacgaccgcggcatggtggatcaggaggtggccggccagctggaggcggccggagagtacatggtggagtaccggatgaagaaaaaggacggctcctttatctgggttcacgatgtgggaaaaaggatgaccgccgaggacggccgggcggccatcacctcggtttgcatcgacatcacggctcaaaagcgcgcccaggaggaagtgctgaacctgtacaacaatattcccggggcggtattccgctgtcgttttgacgccggtttttccgtgatcgacgccaacgacggtctgtttgaatttctcggctattccagggaggaattcgctgcgctgggaaaccggatggcttcggttatttatccggacgacctgaaggtgttggttgataccctgaaccggcagctggccacgggcaatacgatccacacggagaaccgtctgatccgcaaggacgggaccgtgcgctgggtttccgtcaaggcccagctgttccgggaactgagcggagaatcgtttttctactgcgtgtttgtggacatcacggatgaaaagctgcttcagaagcgggagagggagctctacgagcaggaattgtcctattttgcggagctgtcctcggccgggggaagcacacaggggcggctcaatctgacccggaaccaggtggagagttatatggccacagaggatgttgccattgcttcggtggggaacagctacgaccagaccattgagaatctggctgcttccgccgtagacccggtctgcggggagaagatccgcaccaacttaaaccgtgagaaggtgctggcggattacgccgccggtaaagcggatttccatatggattttctgcgcaggcgtaaaggcggcggagcgttttggggaagcaccagcttccgcctctgcgtaaatcctgagaacaacgatattatcacatttttctacacctttgacatcaccgaacagaagctgcgggaacagctgctcatgcagatcgcggcgctggattacgatgtgatcacggagatcaacatccccgcgggggttcaccgcctgatttcctacgatgaacagatcaaggacacgatcatgcgggatggggtattccagaaggagatccgccgcatcgcggaccgttttatggacggcccggcaaagcgggaataccttgcacgtttggattttgagtatatgcagaaacagctggagcatcaaccgtcctacacgttcagcgtggagatgcgcgacaacagcggcagcctgcgcgtcaagcggattcaggtattctacatcagccgggagctgaagcgggtgtgcatggcacggaccgacgtgaccgatgtggtccgccaggaacagcgtcagaaggaggagctggccgccgcgctggtggccgcggagcaggctaacgccgccaagtccgattttctctcccgcatgagccacgaaatccgcacgcccatgaatgcgatcatcggaatgagcaccattgcggcccagcacatcggggacgacgagcaggtggcggactgcatctccaaaatcggcatttcctcccgttttctgctgtcgctgatcaacgatatcctggatatgagccggatcgagagcggcaagatgctgctgaaaaatgaaaagattccaaccgaggagttcctgaacggaatcaactccatctgttacgcccaggccgcctccaagggggtggactacgaatgtatcgcggacccggtgctggacgactattacgtgggcgacgccatgaagctgcagcaggtgcttatcaacatcctcagcaatgccatcaaatttacgagcgagggcggaaaggtcaccttctcggcctcccagcggaagaagacgaaaaacgacgccgtgctgcgcttcattgtaaacgacaccggcgtgggcatgagcgaggagttcattccccacattttcgagcccttctcccaggaatccaccggcaccaccgcggtgtacggcgggaccggcctggggctggcgatctccaaaaatatcgtggatatgatggacggaaggatcacagtgcgctccatcaaggggatcggcaccgaatttaccgtggatgtgaagctggggatctccgaggaggagaagcaccgccacagccagaaaaagcacgattacaatttttcccatctaaaaacgctggtggtggacgacgatgtggcggtctgcgagagcgcggtttcgaccctgcgggagatgggcgtccaggcccagtgggtggacagcggccgcaaggcggtggatttggtggccggtttgaaggacaatggccggtatttcgacatgatcctggtggactggaagatgccggatatggacggcatcgagacggccaggcgcatccgcgccattgtggggccggacgtcaccatcatcatcatgaccgcctacgactggctctccatcgagcacgaggccaagctggcgggcgtcaacctgctgatgagcaaacccatgttcaaatcttccttggtgtcggccttcaccagagctcttggggagaaggaggagcggcggcagccagtcaacgtggaatataatttcgccggaaaacggattctgctggtggaggacaatcagatcaacaccgaggtggcggccctgcttctgcgggataagggctttgaggtggacaccgcggagaacgggctgcgggccctggagcggttcagcaaatccgaacccggctattacgacgccatcctcatggacatccgcatgcctctgatggacggcctcacggcggccaacaacatccggcatctgagcaacgcggacgcgcacacggtaccgatcatcgccatgacggccaacgcctttgacgacgacatcgagaaaagtaaggctgcgggcatgaacgcccacctggcaaagcctgtggacccgcagcggctttaccagctgttgtatgattttgtgttcggcaaggaagactgaaggcgcgccggtgcaacgggcggcgaaggaggggacgggatgaagtctggcgatggggtttaccgtctgatatacgaatattatgaggccagaatacgatgtggtttttatgtctgcggagaccggcttccgtcgatccaaaaaatatgcggaatctttcgaatggcgcccgctacggtgagagcggggctgagaattttagaaaaaaacggttatattaaaatggatgcccgcaaggcggctttggtggtctacgaggcggaatccgccgattttcgccggaacgccgccgcctattttgtgccgcgcagggagggaatacgggatttgattcaggcccagcggctgttaatcgaaccgctgttgcaggccgggatgcgccgtttaagcagagcggagtgggaggtgctgctgcaaggactctccgatcccggcccagggtcggtgtccatgccggtgcagctgtatattctcgccctgaaagctttgaacaacggtctgatcataaactgctactgggaagtgatccgctacatccgttatccgtatctgaccaactgggaggagcggcagcggccggctctggatctgccgggcacgtccagggatgaaattattgatctgctgcagcgggaattggagcggatcaccgccgtcgccgcggggcagctgtacgcctttatggagcaggcggcagcagagtatcacatggagaatgtaaggcccgtgcattttcagtgcaatatttacagccggaggccgcagctgcgctataccctggcctcccgcctgatcagggagatgatcgatcagacctatcccgcgggcagttacctgccctccctgccccagttggcagggacctacggggttggggtgaacacggtgcggcggacgctggagcttttaagccgcctgggcctggtccgctcccatcacggaaagggaaccctggtctgcgcgcagccgggggaaatagatctggggagcccggagcttcgggatagcttcaggctgtaccgggaaagcctgcagtttctggcgctcaccatccgcccggtcacccggtgcgccctggagagcgcggcgccggaggcggcagcggagttaaagcagcgtctgtcttgtttgaaggaggaagagcgctgtctctgtcttgaacgggtactggatttcatcggggtccaatgtccctccatgtttgtccgggagtgctacggcatggtccggcagctgacggcctggggctatccactggaattgcagcggcggaaaacaggtgcagatagcggaggcggcagcggcctcgacaacggccccgattctggcagcggccccggccccgacaacggccccgatcccggccccggcaacgacaacggccccggcagcggccccgcccccgcgaaactgctggcgcagcgcctggaagaggggagcgcggagggatttgcggaggagtgcgagcgctttctgcggcaggaggaggcgcgttacatccggtaaggcaccgccggccgccacatgatatctgaatattcaaactaaaacggaagccgaacatccgggaatctgatctcccggagtccgcttccgttcttttttccgttttttccccaatcagtctccgccggggccgtcgcgccgcggtctggagctctcgggaaggggttccacagaaccgcagcccgatttcctggtccggtcggtatcgcttgatgtgtcgcggttggttgcgtttgtctcgtcctttgccatctctctcacctccggtcttagtatgggtgggaaccggaaaaattatgagttggacaaaaacgtggggacagccctgaaaaaaggaggaggccggtcaggtgttccctgccggccagagtattatgaaaaaaagtcttgttagcattagctctttacatttataagtatagagggaaattgtgagaagaatttgatctttctgtaacacttttatgaacataatgttagcagtttgtgaaccggctaccgcagcaggggcatgcttccggtcagcttgttgaccttcttcttggacccgcagatggccaggccgaagtagtttaactcgtccccggaggcccgggccattttccccatgaattcctcgtaggtcttgcagctctgggccaggtcggtgaagtccaccacggtcaggtcctcaaattcaggctggtaaagcttttcccgaatctcccggatcaggccgggattcccttttaaaatcggaaccgggagctcgacgatgcccaggtgtccgccgcccgattgatcctccacgtcgcagcccaccacgtaaggccgtttcttccccagggtgatgccgaggatcgccgccgtgttggcgatgattcccatcggcagattttcatcgattaccatcacgcatttctcattctgcaagtccattttgtgtactccttttcttccattcaaatttagattccgaaagcagcagaccggtcagggtcagcaggattcccagggcggaggccggggtcacggtctcgcccagcacgatcaccgaggtaaccaccgtgatcaccggcaccatgtaaatataaatgctggtcttgaccgcgccgagtacccgcacggccgtgttccaggtcacaaagcagagagcggaagctccgaaaccgaggaacaggatgttgaataaataaaccgggttggaaaaacgggtcaggtccgggttgaagtcaaacaaaaacagggtgggagccataaacaaaagtccgtagaagaaaatcctcctggtggcctggatggtgccgtatccgaagccgctgattttgcgggtcagcacggaatagcaggcccagataagggctgcggccagggccagcaggtcgcccaccggactcaaggtaaagccctctgcgccgttgaagctgatcaggcagattccggccatagccgccgcgaatccagcgaaaaagttgggcctcagccgttcctcgcccctcatgaacaggtgggtcagcatggcggtgaaaaagggggccacggaaatgatcacgcccacattggaggcaagggtgtaggtgagggcgatattttccagcaggtaatacatacacacgccgcagagtccggccagggcaaaggtgagctcctgccgccgctccttcaggcgcaacatacgggggcaggccagaatcagcgcgacgtagcccatgacaaagcggaaaaataggatttccaccggcttaaaatccaccagcagcagtttggttgagataaatgtggttccccacacgagaatggtgatcagggccgccagatggccggccgcggttttgcgttccatgacagttcctcctagtttgaatggtccggtttctccagaaagattttccggtacacgccgggcgcaactccggtgaacatgctgaaatagttggtgaaatggctctgatccgtaaaaccggtcatgagcgcggcctgggccggggacgtgccctgttccagcagctttttggcctggttaatgcggacgttttccagataacggtagggggtaatttcccgctccttggtaaaggctctcagcagcgtggacttgctcagcccgcagtggcggcagagctgttccagtgtgatccgctcgctgtagtgttcgtccataaaggcgcaggcctggccgatctcagccatgcactccggcatgggcgcgtcaaagggctgggcgtagcgggtgatcagggcgtccagcagaaacagaaaaatttcctccttctcaaattctccggaaccgctcatcaccatattgtgcagggtgatcaggcggccggtcagctcctcgtcctgcaccagattgctggtaaacagcggcggaaacggcgttccggtcagctccctggtgatctcgcgcatcaccggctccgggatgttgaagccgcggtaattgagggcggccccggccagctgggtgcaggcatgtttttcgcccggatggaacagtaccatatcgcccggtttcagcagacagtccaggtttttacaggacagggaacggtccccgttctccaccagacccaccacatagtgttcgtggaaatgcgggggaaaggactgggaaatctcctcaaatcggacggcctcaatctttaaatcgctgtcaaaacagatggtgcgaagctctttgttcattctaaaatcctcctgactcgctctattttaacatgagatccccaggaaggcttgtaaaatatcttcataaatgattaggaaatgacaggaaatgcggcgaaacagccgcggcgaaggaaaaatgccctgaaattaggttgagccggcgaggctgacttcctgtcaatcccaccggcttgaggtatgagataaatgatgtaaagctctgactgcttttgttggatacaatgttcggttgatgaaatctgtgaatcattgtttacaatacatagtatagagaaaatatatggagaaagtttgtccgggtgattaaaaaaatctaaacatctttacgaaagtatgatgaaattgaaaaaatgcgcacaaggggggaatgggtatgatttgacggcggcaaaccataataatcctgaaaatgtattttcacctattgacatataatattatatactgtatagtataagcatattatatgatgtataatataattcaacagccaatattacaagattcagaataggagagatcacatggtatttaatacaggatcggctcttttggacgccatcgtgctggcagttgtctccagggagcaggaagggacctatggatacaagattacccaggatgtgcggcgggtgatcgacatttccgagtccacgctgtatccggtgctcaggcggctccagaaggaagagtgcctggaggtctatgatctggccatcgacgggagaaaccggcggtattacaagatcacggagccggggcgggcgcagctttcgctgtaccggggggagtggagcgtgtactcgcagaagatatcccagatatttgaggaggcgaacatatgaccagggatgcgtttatgagagagctggagtatcttttgcaggatgtccaggacgatgagaaagaagaagctttacagtattacagagactattttgacgaagcggggcctgaaaacgaggaacaggtgatccgggagttcggcagcccggagcgcgtggcagccatcatccgctccgaccttgcgggcaatctggaggagggcggcgcgttcacggagagcggatacacggacgagcgtttccgggatcccggctaccaggtggcccaccgttacgacctgccggaaagcgccgacgggaaagcggccggacagaccggggaaagcggggagagcggaaaaaaagcggaaccgagaacgtccagattattaaaaatcgtgttggtcctggtgctgctggcgttagcgctcccggtggcctggggaattggccaggggctgtggggacttgccgggtgcatcctggcgctgctgatcgtgctgctggtgtttctgggcctggtcacagtgggtttcctcattgcaggcgttattatgatcccttgggggatcgtgatggccttcgcaagcccctggagcggcctggtggtatttggaagcggcctggccctggccggtctgggacttttgggtctggcgctgtccgtactgttttacggccggttcgtgccctttgtgatccgggggatcgcggactgcctgaaccgtttcttccacaagaacaggagggatgaagtttgaaaaagatgattaagatctgtgcggtggccggcgcagtcatgctggcggtcggaattcttaccacttttgcggcggtgagctttggcggagcccgccgtctgggaagcggagtgaagaacgcggtccaccgcgccatgagctgggcggacgacgattggattgacgatttggaggacccggattactgggacgaactctgggaggatgatttctggagcgacgaggccagccacagcagaagccgcgcccagaatccgcctggggacggggctggtcaggagccgggacttccggcccaggccgggagcagcggccccggatatgccggaggtgaaaacggtggaaattttgcaggagccggcggtgaggctggcggaaatttcgcaggccccggtggtgaaaacgccgggaatcccgaaggcgctgccgggattctccccggaagccaggcccgcagcggcccggcggcgatggaagagcgtgaggacggcagctggcatgtgaccggtgtggcggagatggacatcgaggtggaccgcggttccgtgcgggttatatccagcgctcaggccgaagacatttccgtgcgcatgaaggacgagacggggagagcccgctgttatctggacgatgataaactgaaaattgagcgcgagttcaagggcagccgcaaggaggccaagatcgaggtgatcgtgccggaaaactattactttgacaaggtcgaggtggaggccggagccgccgcctgcgagataaacggtattgtgacccgcaagctggagctgcagagcggcgtcagcagtatggcgttcaccggacgggtggacgagaagctggaagtggagacaggagtcggcgtcacaagcgtaaagctgacgggtagccgggaagattataactataaaattcagtgcggcgcgggcagcgtgaatatcgacggcgaccaatacagctcccttggcgtggagcgaaagattgacaaccgcgcggcaaggagtatggaactggagtgcggcgtgggcaccattgaggtgcagtttacaggcagcctgtgaggaaaggagcaactatcatatggaagcgaataaaagactttaccggtccaaccggaataaaatgatctgcggcgtgtgcggcggcgtggcggagtatttcaatattgacccgacaatcgtgcgtctggtgtttgccatactggcattctcctggaagggtctgctgatctacttcctggcggcgatcatcattcccatggaacccatgtaggataccgtcaaaagggaaacggacggtccgatcattataaaaaggccgtgtgctttggattgcctcgcacacggccttttgccgtaccaatcaaccgcgctcccgcaaacctaaaccgcgggtttaccgctccgcgttgtagagctttaccagttccggcagcacgttttggggctggtccacgatgaccagatccgccaggtggtccttgtagtgttcgctctggtggatgatggccaggcgcctgccctcgaaatagttgatataatggcgatacacctcggattccagggtggtgcccaggagtaggagtaagtcggccttggagacctcctccgtggtccgggtcatcagctggctgtccacctgctcgccgaacaggttgaccagggggcggaccgggatgccgcaggtctcgcacagcggaacccgcttggcggacttgatgtattccaggggatagttccgtttgcagcgcgggcactgattttcgtaaatgcttccgtgcaggttgatcacgttcttacaaccggccagccgggcctgatcgtaaatattgctgcaaaccacgcagttgagctttcccagatgttccagagaggccatggccgggctggactgcgtggctctgggcgcgtgttccagcatttcctttttataaaactcaaaaaacagctccggccgggtgttgtagaaggcgctggaaaatatctcgtcggctgaatagccgtaagcggcctcaatctcgtagtcccgctcctgctttttgactccgatgaagccgccctcctccatcatcccggagccgcagagcgccaccgtatagctgctctcatccagaaaactttttaaataggaaagtttgctgcacattcgaatccctccttctctaccggaatatcacataatacgttttcttaattctaccatgtcaccaaccgacaggttgatgacatgagatgcgtttccttaattataccatggggcggggaaaagtacaaagtgtttcagggtatatcctacttataaaatactggaaatacaggaaaatcaggcgaaaggccccagaaaaaggaggggccggcaaagggggatttgccggctgtaggtatgaaaagcttttttatttgaaaaggcgtctgccttgtacgatttatagtatagagcttaaatgtgtccaaagtttgagcgcagaataaagaaaaaataaaaaacctaaaggattctttaacaaccccggaagaaaacgtaaacgctctgaaaaaggggtggagccggggaatatacccgcccggctccggcaggtcaggcgttttcccagtccgggcttgtggggcggatcacgccgcatccgatcttgtcgccggaatttcccgagggctgggtggtgaaatcatcggcgcgggagtggatgatcacggaacggttcaaaatatcgtcgatggtaaagcgtttgtcgtaaaagctcaaccaggcgtagccctgattggccagaaccggcggcatgtcgccagcgtgatccgggtggggcatgctggtgggattgtagtgctccccggtgttggcaaagttgtcggagcagtcgccgaactggtggatgtgcatggcgtagaagtccgaggacccctcacggtccacgttcggcagtccgaagaactccgcctccaccagcacaccgccgtagggggtgtgataaaacttgaccagaccgctgagctgggtggccttggaattgcctgtcacccaggccatggcctggggacggttttcggccagcaggttggtaaatgccattctgggcgtgatttgattggtttgcatggaagcctccatttttcctgtcaccttatcatatgccgcgcccgggcatttgcgtacccgcaggaagaaaaggactgggtcttacagctttccggtaacggttttggggatggtgaaatccaccgcgcccatataaccgggggctacgtcgtactcgttgaaggcgatcaccagctggccggattcatcaaaatagaaactctcgctgccggtgagacccttgaaatccgtctcaggcatatcgctgtccaggaaatactgtttgttctcgtcctcagccatctggctgcgcatttgctctttgatgtttttggagattttgtccagcgcatccggccggttggcaaacaggtccttcagggagatcacatttcccgtggccttgtcaaccgtaaaaatctttacgaactgagcgccgctggccatgatttccgtggtatcgatgcgcaggcacaggtacttgtcattgtccgtcaccaccttgtaagagctgtccagggaatagtggccctcgccctggtctgcggccagctccttctcgtactgggcgatcagctcgtcggcgtactcttcgatggacttattcaccttgttctccgtgtttccgtccaatgtcacctggggaacctgaatattggcctcaaaattgtccttctgatcttcaaaggtgcggaaggtcaccaccttggcgatggagccgatcacgggcagctgttccattgcgcttgcagtggtgggggttaagtttgccatcacggtgatcatcaccatggccgcagccgcggtagctccggtagatttcataattttcatataattacctcgtttctgttctttttttgcctggttgattccctgcatgatccgcgcgcgcgcctggggcggcaccgggatcgactcatattcccgtttcagttcgtccataatctgcttttcgtcctgcttcatctcggtttctcctttcccgaagcttcgtaggcgccggcctccaggtccagccgcagcttctttaacgcccggtaaagcctcgccttcaccgtgtttaggttctcgcccacagtccgggccacgtcctccagtttcatatcttcaaagtaccgcagaatcaccacggtacggctgcggtcatccagccgctccaatacgccgcgcagatccacatccccgtagctgtcctcccagacggcttcgggcagggtgtccgacagttcctcgcgcttgcgcttgcgaaccgtgtccagcgccgtgttgatgacgatgcggtacacccaggtggccaggtaatccggattccggacggttttgcagtcccggatcgctttgtaggcgctttcctggacgatgtccagggcgtcctgttcctggcgcacatagctgtaggccagccggtaatatgtctcgtagttctccagcagcaggcgttccacctctgtttcctgtttggaacccatgtacattcctcctttcgctgttctgaatgttagacgccccgggaggcgtgaaagttgcattgagcacggattattttttactattttatcccattacaaataaaacgcaacattcattgtttttttagacaagaaatgatatattggtggtattgtgattgacaaatgaaaatgtacaagaggtgagtaccagatgacagaagagaacgggagaggaacaaaaccggccaagcccccggttcatcagccgcggcaggtcacaccaaaatccaaggagcgccctgagaaccgggagagccggtccaggaggtccagagggcggcgcatcgcggtgtttcccatcgtgctggccctggtgatcgggctggcggccggattcggcgccggctatatgaaatggaagtgggagcgtccctacacggtggatttgaaggccgtggaggtgccaaagtgggtgaaacaggaatttatccgcaagaacatattttcgcggccggacgtgagcctgaagcgggtcaacaacattgtgatccactatgtggcaaaccccggcacatcggcccagaagaaccgggattatttcgacggtctggcggatcaggatccgcaggcagcgggaacgtcggccagtgcccactttgtggtggggctggaaggggaagtgatccagtgcattccggtcagcgagatggcctacgcggcggccccgcgcaacaacgacaccatctccatcgagacctgccacccggacgagtcgggggcatacaacgaggccacctacgaatccctggtgaagctgacagcggccctgtgcagccagcttaagctggatgaaaacgacctgatgcgccattacgacatcaacggcaaggtctgccccaagtattttgtggacgacgaggccgcctggaagcagttcaaaaaggatgtaaagacagccatcaaggacaagacctgggtggagtgacagaaagcggcggagcgaacgcgccgggatttcggatcccgcgtgtccgctccgcttcggctgagtgcaatgggcagttggccggaaacttcacgctccggtccggctggctacagcggaagaaagaccggcttcctctgatggaacaccgtgtaatacttgaagccgcagcgtttcagaagctcgcggcagtagtcgaaatcatagcccagatgctccggcttgtgggcgtcggagcccacggtgagaatctccccgcccagctcccggtagcggaccagcacttcctctgtggggttggggtgtcccagaccgtatttgaggccgccggtgttgcactccagacccttgccgcggcggatcaactccaccagaatcatgtcgatgagatcgcgaaagcgcccgtagctgtactgttcgttctggtgaggggcatagcggaccacatagtccaggtggccgaacacgtcgtagcagtccatggttttggcgttttccagggatacgttgagaaaacgctcaaaagcttcggcctcggtgcgcccggcccagaagttttcatcaaacgggtccagccggtcggcgaaatggcaggagccgataataaagtccagtctgcccccaaaacgttccaccaacgcgtccagatattgcttcaggtggggctgaagccccagctcgatcccgatgttgacccggatcttgtcgcggtactccaggcggatctgctccagggaatttaaatagggagggatgtccagatagaagtttgtagcgcagaaatccgagtcatagtcgtggtggtcggtgatgcagatctcctccatccccagcgcgatggcccggtctatctgtgtccggaccggcgtctcgctgtccccggaaaactcagtgtgcatgtgaaagtcacagatcatagtcgattctccttggaaaaaatagttccaacatttctgttggccgtggtgccgttgcgtttagcggctctataatacttatatcacaatctgaggcggttcgaaagcacaatttgtatgggagggttgaatttgacgttttagccggaaatgcaccggtttggcgcgaaaaccgccggaaatgcgcgaagcgatcattctgctgtcaggatacccggatatcatgcgcagaaggcaaaaatagacgacaaagggttagaaagccgttattccgaaatgtaggatttgacaggaataacggctttttccatgaataaatgtatgaaaaagggaaaacaataaaaaaataaaaaaggacttgccatttctattgaaattgattacaatataggaaggttgattaatatttaacaataatatattttttaacaaactaggaggaattgatcatggcagtaaaagtagcgattaatggttttggacgtattggacgtctggctttccgtcagatgttcggagctgaaggttatgatgttgttgcaatcaacgatctgactgatcccaagatgcttgctcatctgttaaagtatgataccgctcagggcggatatgccggacgtttaggcgagggcctgcacaccgttgaggccggcgagggctgcatcatcgtggacggcaaggaaatcaccatttacaaagagcccaaggctgctgacctgccgtggggagagatcggtgttgacgtagtgttagagtgcaccggtttctattgctccaaagataaagcacaggctcacatcgatgctggcgccaagaaagtggttatctccgctccggccggcagcgatctgaagaccatcgtttacagcgtaaacgagaacaccctgaccgctgaggataccattatctccgcagcttcctgcaccaccaactgcctggctcccatggcgaaggctctgaacgactacgctcccatccagagcggtatcatgagcaccatccatgcttacaccggcgatcagatgatcctggacggaccgcacagaaaaggcgatctgagaagagcaagagccggcgctgccaacatcgttcccaactccaccggcgctgccaaggcaatcggcctggttatcccggagctgaacggcaagctgatcggttccgcacagcgtgttccggttccgaccggttccaccaccatcttaaccgctgttgttaagaaggtcggcgttaccaaagaagagatcaacgccgttatgaaggctgccgcttccgagtcctacggctacaacgaggatcccatcgtttcctccgacgtaatcggcatgaagtacggctccctgttcgacgcaacccagaccatggtttgccagatcgcagatgacctgtacgaggttcaggttgttgcctggtacgacaacgagaactcctacaccagccagatggttagaaccatcaagtacttcgctgagctgggctaattggaatacctcaataaaagcaagaagatttagtagactcatgaagggtccggtcgtttggaccgggccctttttaagcgcaaagcgccggcttgcggcaaaatgccgttagaacatgggccggtgatcatctgaaaggggatttaaactatgttaaacaagaaaacagttgacgatctgaaggatttacagggcaagaaggtactggttcgctgcgatttcaacgttccgttaaaagagggcgtgatccagaactacaaccgcatcgacggcgccattcccaccatcaagaagctgctggatcagggtgcgaaggtgattctctgctcccatctgggcaaacctaagggccagccgctgcccgagatgagcctggctcccgtggctcccgctctgagcgagagactgggcgtggaggtgaagttcgtggacgatccccaggtgaccggcgaggagaccaaaaaggttgcagctgagttaaaggacggcgaggttctgctgcttcagaacacccgctacagaattgaggagaccaagtacaaagagggcgatgccgctacggaagcttatgcaaaagagctggccgatctgtgcgatggcggcgtgttcgtggacgacgccttcggaaccgctcacagagcccactgctccaacgtaggcgttaccaaatacaccaaggagaacgtggttggctatctgatgcagaaggaaatcaagttcctgggccaggccgttgagaatccggtccgtcccttcgttgccattctgggcggcgccaaggtttccgacaagatcaacgtgatcaacaacctgctggataaagtagacaccctgatcatcggcggcggcatggcttacacctttgccaaggctcagggccaggagatcggcaactccctgtgcgaggcggataagctggattacgctctggagatggtgaaaaaggctgaggagaagggcgtgaagttgctgcttcccgtggaccacgtggaaggcaaggagttctccaacgataccgagcacaaggttgtggacgtgatcgacgctggctggtccggcttcgacatcggccccaagaccatcgagctgtacaaggatgctttaaagggcgccaagaccgtggtttggaacggacccatgggcgtattcgaattctccaactttgcggagggcaccctggaaatctgccgcgcggtagcggagctggcggacgcgaccaccgttatcggcggcggcgattccgtgaacgctgtgaagagattgggcttcgcggacaagatgacccacatctccaccggcggcggcgcttccctggaattcctggaaggcaaggagctgcccggcgtagctgcggctgacaacgcctgattgctgtttgtgaaatgacgatggccccctgtgaacaagggggcttttgagggataatgcacatagaaggagaagctaaaaatggcaagaaagaaaattatcgcaggcaactggaaaatgaacatgactcccaccgaggccgtggctctggtaaacgagttaaagcccttggtggccaatgacgaggtggacgtggtgttctgcgttccggcaatcgacatcatccccgccatggaggctgctaaaggcagcaacatccacatcggcgcagagaatatgtactttgaggagaagggagccttcaccggcgagatttctccgaatatgctggtggatgccggcgtaaaatatgtggtgatcggacattccgagcgccgtgagtattttgcggagaccgacgagaccgtgaacaagaaggtgcttaaggccttcgaacacggcattacccccatcatctgctgcggcgagtccctgacccagagggaacagggcatcaccatcgactggatccgccagcagatcaagattgcgttcctgaacgtgaccgcggatcaggctaagactgccgtgatcgcttacgagcccatctgggccatcggcaccggcaaggtagccaccaccgagcaggcagaagaggtctgcgcagccatccgcgcctgcatcggcgagatttacgacgaggccaccgctgaggccatccgcatccagtacggcggctctgtgtccgcttcctccgctcccgagctgttcgcacagcccaacatcgacggcggcctggtgggcggcgcttccctgaagccggatttcggaacgattgtcaactacaacaagtaaaatgatggaagtaacgccgcggctttcggttccctgggtttgaacagggagggggacgcggcagggcgaatgcttcttccgtcccggacagtccttggaagagggggttttgggaggcagaagcatttgcgtgtcttagaaggagatagaaaaacgatgagcaagagaccaaccgtattaatgatcctcgatggttacggcctgaacaagaactgcgaccacaacgcggtctgcgaggcgaaaaccccggtgatggaccagctgatgagccagtgcccctttgtggagggccaggccagcggcatgttcgtgggacttcccgacgggcagatgggtaactccgaggtgggacacttaaacatgggcgcgggccgtatcgtgtaccaggagttgacccggatcaccaagtccatccaggacggggactttttcgaggtgccggagtttttgaccgcggtggagaactgcaagaagaacggctccgccctgcatctgttcgggctggtgtccgacggcggcgtgcacagccacaacacccatatttacgggttgctggagctggcgaagcgtaacggcctggagaaggtgtatgtgcactgcttcctggacggccgcgacacgcccccggagtccggcaaggattttgtggcccagctggaggctaagatggccgagatcggcgtgggacaggtggcgtccgtgatggggcgttactacgcaatggaccgcgataaacgctgggaccgcgtggagatggcttacaacgcgctgaccaagggccagggcaagactgcacagagcgctaccggtggaattcaggcttcctacgacgacgggaaggcggatgagttcgtgattcccttcgtggtggagaaggacggtaagccggtggcaaccatccaggatcgggattctgtaattttctttaacttccggccagaccgggcacgggagatcaccagagccttctgcgacgacgagtttgacgggtttgcaagggagaagcgcctggatctggtgtatgtgtgctttacggattatgatgagaccatcgcgaataagctggtggcgttccggaaggagagcatcacgaatacctttggggaatatctggcggctcacggcaagactcaggtgaggattgcggagactgagaagtatgcgcatgtgacgttcttctttaacggaggcgtggaggagccaaatgaaggcgaggaccggattctggtgccgtcgcctaaggaagtggctacctatgatttgaagccggagatgagcgcgccgcaggtttgcgataagctggtggaggcgattaagtccgggaagtatgatgtggtgattatcaatttcgccaatccggatatggtgggacataccggcgtggaggatgcggcgatcaaggccattgagacggtggatgcgtgcgttggacgcgcggtggaagccgttaaggaagtggacggcgtgatgtttatctgcgcggaccatggcaatgcggagcagctggtggattatgtgaccggcgatccgtttacagcgcatacgacgaatccggtgccgtttattctggtgaacgcggacccgcagtataagctgcgcgagggcggggcattgtgtgatattgtgccgaccctgatcgagctgatggggatggaacagccgaaggaaatgactgggaagtctttgttggtaaagtaagatagaaggatagagaaaaaaataggccgtgccggccctggaattgtttctggggggcgcggccttttttgatgcatccgttcgtgaggcggcgggaaccggggctggagactccgggtctttgcgatggcagcgtctaagggggaaggaacacgaaaaggcgggcaccgctccgagctccggcgccggccttaagccggcccctccgcctccgctttgctccgggctttgagagccctgcgcaatcccaccttttcgcgtcccttccccctaagtcgctgcgaatcgctccaaagtcgcctccatccccggttcccaccgcctcacccgctaggggttgggggaatttgggtggggttattttggggggaggcgggagactagggcggtgtgggcgagggtgaggaggcggccggtgaggctgcctaggagggagatggtgaagtaaccggtgtagaggatgtaggctccctgaaggtgattgagtagggtggggcctgctacgatgtccaggagggcaatggggagagcgagaaagggacagaggacggcgtggaggatgaggggattttggggacggaggccgtagaggagggagatgaggaaacagcctaaggggatggttccgattaatagacccaggcccaggtcgccgatatcacagtctggatggcggcgaagggttagggtgtattgggcgatggggatgagatagaaatttatgagatgcaggggaatgtactttttcatggcgcgccaccttttatgggaatattgtaccttgccggcagccaaaggctgtcgataggagctatgttttcttgattgtaacatgaagagaacgggaggaacatatggagtttgtcattttgggagtgacatttgtcatgagatgaaagcgggattgagggaagtttgatttgaacaagaaagccgccggtgttggccggcggtttgaggtttggttttggtttgaatgaattttcaaattatcttgttcgctgtagtactaggagtgatgggcggccgccagctccaaagctgcttcggacgccagatcctgggaggcgactttctggggggcgtcggcgggctgctcgggtttggccgctttggcggcgggtttggtctcggccttcttggcggggatgctgccggagaggcggatggcggctttggcgcaggccgggcctaccatctcgtagaggattccgctggacaggatgatcgtggagagcatctcgccgctggcggccggaagcattctctggccaagcacggccaggccgatggatacgcctgcctgggggattaaggccagaccgaagtatttctttatctcaggtgtcgcattggttaccagggcgcccagggtggaaccaaggtatttgccaacgatacggaccaggaagtagatcacgcccacaaaaccggcgctgatcaggctgggcagagagagccgcatgccggacagcacgaagaacataaccaacaggggcggggtgaactggttcagctgcttgaacaggtgcttgtttccgctggtgttgatgtagatggtgccggaggccatgcaggccagcagcggggatacgttcatggtggaacagaaaccggcaacgcccataatgcacacgcaggccagcaccaggctgtggtctttgctgcggcgctcgtggatcagcttgctgaggagccagccgctgcctccgccgatgagcagagccacgatgttgaagaaaatgggcagcagaagctgggtcatgttcaggccgccctcgcctgcggtggcctgcacgatggcggcgcaaacgctgaaggcgatcagggcaacggcgtcgtccagagccactacctgtaagattgtgtcgataaagtggcctttcgccttgtactggcggatggtcatgatggtggaggccggcgcggtggcgcagccgatggcgcccagcagcagcgagaagggcagagacagccctaacagcagcatgacgatggtgatcagcacgccggcggtgagggattcaaacagggtcaggataacgaccttgattccgctctttttcagggccgagagcttgaagtatttgcccacgccgaaggcgatgaaggcaagcgccacgtcggtgatgaaatccatctggctgatatactcctggggaaccaggtgcaggcaccagggtccgatcaaaacaccggacagaatatatccggtgacgttgggaaggtgcgccagtttggtgagtcttgtgaacagaaatccggaaatcagcataattgctgcggtgaggatgattccggaaccatgaagatttaataaaatttgagccatagtgatactcccctttccattatgtataactgatacatcatgtcatagctcaaagccgtgtatatatgaaataccggaaatcatgcttaaatgcttcggtcacaggctttccagcctttcatacataagcggcttttatccacgctttcccccggtggaatgaagctatttctttgttctgcttgattatagtagcgtttggtgataaaatcaaacgatataaattgattggggcataaagaaaatttatgccgctgaggaggacggggtatgtttgattcaaaggcgaatacgcttctggcagtggtacaaaccggaagttacacgaaagcggcggcgaaactaaacctgacgcagccggcggtgagccaccacatacggctgctggaaacggaattcaatattaaattattttatagagataaaaataagttgaaattgacgccccaggggaaaattctcgtacaatatgccaagcgggccgccgctgtgtacgcgaatgcctgccaggcgctggaggacagcaagacgggggccgggcacttaaacgtgggcatcaccccaactgcgggcgagaccattctgccccaggttttggctacgctctgcaatgaaaatcccaaaatacatataaacatttgtatgaacacgattcaaaaaatttataaccggctcaaaacctatgagctggattttggggttgtggagggcgcggtgccggatgagagcctggtgaccacggctctggacacggattacctctgtctggccgtttcgcccatgcaccggctggcccgggccaagacggcttccgtggaggatatccgccacgaaaagctgatcctgcgcagccgcagcgccggaacgagacagctgtttgagaaacatctggaggcaagggggctgtccctggagggcttcaatgtgatgatggagctggacaacgtggctatgatcaaggagctggtgagcatggatatggggatcacggtgattgccaagagcgcctgcagggaggaagcggcggccggacggctggccgtcatccccatcgagaattccagtatggtccgccagatcgacatcgtctacctgaaggatttcatgcaccctgagattattgagaatatccgggagatttacgagcagctccggggcaagtgagcgttgtctgttttgcggacatagaaataggaagtgggagagaggattggtcagatgagcattaccatttcatttacgatggaaccgaagatgagcctgacgggcacaaaaccctgggacggggagcagaccgcagggttcacgaaagggctggcaaaggagctggggtatcactgcgacgtgatttccggatatgtggtctaccagctgtgcccggagggatttttgtggatgacctggaagggaaagcagctggtgggggactgccagaccaatattgcggggccgggatttcatgcggccgtcgtctattttctggaactgttcgcggccagggggagcctgaagctttcggtaaaggaccccaccgggttttacgcggaccggaatttcgagcgcatgcgccgggagtatttctacggctggtttaagaagctgctccatgccattgtgtcccgggtggggacgggcgagggcaagctggtgtgctggccctcggactattacctgccccaggagcagccgggaatcgtgatgacccatatccggggcttcggagtccgggagcttaaggggatcgtccagtccgggctgacgaacgcctttgccaaggatttttttgtgtggtgcgacgaggagaaggacgcctggtatttccgcaactgcgccctggtgctgctcaatcagcagtgctattttaagccctcctcccgcagcaatgaggacctgctggtcaaccgcgaggtgatccgtttgctggaaaagaccctggaaatggaccggacggtgccgtttcccgtggcggaataccgggaggtgtgcgctttggacggacatgaaccggcggaccttaccggcgtgtgtcctatgacggaggagcagcccgtgggctgccgcagagggcttttgcagcggaccatcggccggatgcgctttgcggtgccgggaagctttctctacgacctgcagacccagggaaacgcggagcgctattatgatgagagcgatggaaaccgccgggattactacatctgcgcggtcaagaccgagggggacgcccagatccgtccggagccctttgagcgggagacggtgctgcggacggaggaattcgccgcgggaggcgcgatcgggaagcttgcggtctacaagccgtcaaagcggccgctgccgggaaaacctgcggtgaccaatgcggtgctggtgggcgagagcctggccttccggcgcggggagcctcaggaggatacggggcttaaggagagcatcgcctacaccgtggcggcccagatcgcgtacagggatcagctgacaatcgtcagcatcacctccgggcgggcggaggacgaggcgtgggccatcgatctgatccgaaaggtggaagttgtgggctgagccattcagggactgaattgttaccggtattgtgtgtaatctgtggaaacaaatgtgcgtgaccagttgacaaacgcggtacatgttgttacaattataaagatactataaaacttatttaaaaaataagatgatggaggttagtatgaaaaaaattcttagcatttcgctggcagcgatcatgatctcatcgcttgcagcctgcggaaacagcagcagcacgcctcagaccaaggccgttgagacacaggccgaaaccaaggctgaggagacaaaagcagaggaaaccaaggctgaagaagccaaagaagagaccgaggccgccggcgagaaggctgccgccgattaccacattggtatcgtaaccggttctgtttcccagtccgaggacgaccgccgcggcgcagaagcgttccaggcagagtacggcgaggacatggtaaagcttgccatctacccggacaacttcaccgaggagcttgagaccacaatccagacaatcgtaaacctttccgatgatccccagatgaaggcgatcatcgttaaccagtccgtaccgggcaccaccgaggcgttccgtaagatcaaagagagccgccccgacatcctgtgcatcgcaggtgagagccacgaggatctgccggagatcggcagcgcggctgatctggtctgcaacaacgacttcgttgcccgcggctacctgatcatccgcaccgctcatgagctgggctgcgacaccttcgtacatatctccttcccgcgtcacatggcttatgagaccatgagccgtcgtgtggccatcatgcaggcagcctgcgaggagttcggcatgaagttcgtacttgagaccgctcccgatcccacctccgacgttggcgttgccggcgctcaggcttacatcctggagaaggttccggagtgggttgagaagtacggccagaacgccgcttacttctgtaccaacgacgcgcacaccgagcccctgttaaagcagctgcttgagtacggcggctacttcatcgaggctgaccttccctccccgttgatgggttatcccggagctcttggcatcgacctgaccgctgaggccggcgatttcgagaagatccttgcaaaggttgagtccacgatctgcgagaagggcggcgcaggccacttcggcacatgggcatattcctacggctacatccagagcgcaggtcttgcacagcacgccatgaacgtgctcaacggcgagagcgagctggacgacatggacgacatcgcgaaggcatatcagaaatattcacccaaggcggagtggaacggctccaactacaccaacgtagacaccggcgttaagctgggcaacgtattcctggtatatcaggacacctacatcatgggcgatcccggacatttcatgggctccactcaggttgaggttccggagaagtatttcaccattaaataagtcgcttataaaaacagcaagtatgggaaacagggggaggaaatttcctcccccattgttataggtgggcacaatatgatagaaaataatgctcctttgttggagatgcgaaatataaagaaggatttcttcggaaaccaggtcctgactgatatcaatttcaagctgaacaccggcgaggttctgggtcttgtgggcgaaaacggcgccggcaagagcaccctgatgaagcttctctttggtatggacgtgatcagagagaccggcggatatgagggcgacgtgctgatcaatggtgagaaggtcaacttcaacacccccttcgatgccctgcatgcgggaatcggcatggtccatcaggaattttccctgatccccggcttcaccgccactgaaaatatcctgctcaaccgcgaaccgaggaaaaagagtgtgatcgccgaggtattcggagatcgtctggacactttggattacaagaagatggcagagctgtccgaacaggccattgataaaatgggcgtgaagatcgatgcggacatggcgatcagcgatatgccggtaggccacaagcagtttaccgagatcgcccgtgagctcagcaaggagcagttaaagctcctgattctggacgagccgacggccgttctgaccgagcaggaggccgaagcgcttctgagctccattcgcggcatggctgccaaaggcattgccgtgattttcatcacccatcgtctgcatgagattctttcggtctgcgacaaggtcgtgatcatgcgcgacgggtatgtggtaaaagatgttcccgccggggaaacggacgtggcggatatcaccaaatggatggtgggaagaaacatcgcgtccgcggccaaggcggatatcaagatcaaccccaacgccaaaaacattatgagcatccgcaacctctgggtcgacatgcccggcgagacggtgcgcaatgtaactctgcatatcaaggaaggcgagattctgggaatcggcggcctggccggacagggtaagctgggaattcccaacggcgttatggggctttacgatgcgggcggcaccgtggaattcgacggccagctcatcccgctaaacaacccaagaaaatgtctggattcctctctggcctttgtatcggaggacagaagaggcgtaggcctgctgctggacgagacgctggagtggaacgtggcgtttacggctatgcagattcagggcagattccttaaaaaatacctgggcggcctggtcagctggagagatgaaaaggcgatccatgaggtgacccagaaatatatcgatgagctgatgatcaagtgtaccagttccaaacagaaggcaaaggagctttccggaggcaaccagcagaaggtgtgtctggccaaggcctttgcgcttcagcctaaattcctgtttgtatccgagcccacgagaggaatcgatgtcggcgcgaaatcactggttttggacgccctcaagaagtttaacagggaacacggcgtcacggtggtgatgatttcgtccgagcttgaggaattgcggacaacctgtgaccgcatcgccattgtttcgggcggtaagatagctggaatcctgccggctaccgaatcttcggaaaaattcggcctgctgatggtcagtcaggttaaataagggggagacagcatgggaaaaaatgcagataatacagccggttccggattgaaaggcaaaatcacggaattcgttcataatttcggccttcccagagtgatcatcgccggattccttctggcgctgttcatcctggcgcccgtggtgggggcggatctccccacacagatcagcaacacaatcaaccgtttcagctggaacgcggtaatggttctggcgatggtacccatggtgcactcgggctgcggactgaacttcggactgcccctgggcatcatctccggcctcttgggcgcgaccatgtcgatccagttcggcttcaccggccccatgagctttgtgatggcgatcgtgatcgcaacgccctttgctctgatcttaggcggcggctacggctggctgttaaacaagatcaagggcggagagatgatgatcgccacctatgtgggcttttcctcagtttctttcatgtgtatgatgtggcttttactgccctacaacagtccgaccatggtttggggactgtcgggcaagggacttcgtaccaccatctccctggagggcttttacgataaggttctggccaacttcctgcacattcagattggaaatctctccattccggtgggcagccttctgttcttcgcggtgctggccttcctgatgtgggcgtttctccacaccaaaaccggtacggccatgaccgctgtgggttccaacccaaactttgccagggcttccggtatcaacatcgacaagacgagaatgctctcggtgattatgtccacctggctggccgccatcggcatcctgatgtatgagcagggctttggctttatccagctgtacatggcgccgttctatatggcccttcccgcggtttccgcaatcctgatcggcggcgcttcggtcaacaaggcgaccattaccaacgttatcatcggtacgttcctgttccagggtattgtgaccatgaccccaacggtaataaattccatgattcatatggacatgagcgaggttatccgtatcattgtttccaatggtatgattctctatgctttgaccagaaagacggagggatcaaaatgagtacaaaacaaaaaaagactggagcgaaaagccccctggaattgcttcgcaataactcagtgccgatcatgtttatcctgatctgcgccgtctgcataccggtatccggcttctcgccggggtatctgatcaacgagattctcaccagaatgggcagaaacacgtttttgatcctcagcctgctgattccgatcatggccggcatgggtctgaacttcggtatgaccctgggcgcaatggccgggcagatcggcctgatctttgccgctgactggcagatctggggcatccccggcatggtactggccgtgatcatttccattccgatctccgtgcttctgggccttttctgcggaaagatgctcaacatggccaagggccgtgagatgatcaccagctatatcatcgcctttttcatgaacggtctgtaccagctggtggtgctgtacatgatgggacctgtgatccccatcaaacacgcctccatcaagctgcccagaggctacggcatccgcaatacggtcagcctgctgaacatgcgtcaggctctggacaacctgtgggccatccgaatcggcggcgtgaagattccggtgctgaccctgttaatcaccggtctgctgtgcctgtttatcatctggttccgcaagaccaagctgggccaggacatgcgtgcggttggacaggatatggatgtggcccgggacgccggtatcaaggttgagagaaccagaatcatcgccatcgtgctgtccacggtctgcgcgggcatcggtatggtgatctatttacagaatatgggaaatatcgccacctacagttctcacacgcagatcggtatgttctgtatcgcggcactgctggtgggcggagcttccgtggacaaggcgtcgatcggcaatgcatttttgggcgttgtcctgttccatctgatgttcattgtggctccgtcggcgggcgcgaagatcacgggcgactccatgatcggcgagtatttccgcgtgttcgtttcctacggcgttatcacccttgctcttattatgtacgagacgaaaaagcggatcgccaagggcaaagccggcgaacagttgcagcttgatcagagtgaggaggagtagaagtgaaaaacagacgagctattatattcagggtaggcgctatcctgctcctgctcatcattgccgcttccatgatggtcatcggccgcggccacaccgtttatatggataacaagaccatagagtacgacggccagacctacaaatcattctataaagtggacgtctacgtggacggtgaacgggttgcaaagcttcgggacaaggacagaggtatggccaccaacatcggccagaaattcaccatgaccctggccatcacccgggagaagggcggccccgaggaaaccgtggaggtgacgctcaatctgccttacaacatggacggaatcgccatcaaccttccggcctgcatggcgggacttccgggagatgtgtgtatgacagagtttgtgatcgagcctgcggagtctgagaccagcgaggagaatgtggacgagtttggaatcgacgcagagttctaagctgcgcttgaagcagtattattataagaaataatccagagggtgtcccggaaacgggcatcctctttggcgttattggatgcaatgggaattgcccgaaaaggttatgcttttcctgtggaaaaagacaaggttttgtgatacactagtaaacatcaccgggtccggaaatttggagaaaagagatgaaaactagcaccctgttaaaaagatttgtcccctactaccgaaactatgtggggattatgataatggatctgttctgcgccgcgctcacgaccgtctgcgagctggtgctgcccctgattcttcgctatattaccaatcttggtatgaacgatctgtccgctctgaccgtgcggaccatcgttaccattggagcgctctattttgtgttgcgcatcatcgacggcatggccagcttttacatggcttacacgggccatgtgatgggagcttccatcgagacggatatgcgggaggacgccttcgcccacttgcagaagctgtcggataattatttcaacaataccaaggtgggacagattatgtcccggattaccagcgacttgttcgatgtgacggagttcgcccatcactgcccggaggagttttttatcgccttcgtcaagacggtggtgtcctttgcgattctggcgcggatcaatgtgctgctgactgtgatcattttcgtgctgatcccggttatggcagtgtcctgctcctattttaacctgcaggtgagaaaggcctttaagcggcagagaaaccacatcggtgaattaaatgcgcgcattgaggacagcctgttaggcaacaaggtggttcgggcctttgccaacgaggcggtggagatcggcaagttcaaccgtgacaaccaggaattcttaaagatcaagcgccagacctataagtatatggcggcgttccagaataccatccgcatgttcgacgggctgatgtatgtggtggtgattgtggccggcggcattttcatgatcaaagggctgatcatgccggcggatctggtggcgtacacgctctatgtgaccacgctgctgtccacgatccggcgtatcatcgagttcgcggagcagttccagagaggaatgacgggcatcgagcgttttaccgagctgatggatgccaacatcgatattttcgacgaggagggagcggtgccgctgcgggacgtggagggcgaaatcacgttcaaacacgtgtccttcgagtacccggacgaccatacgccggtgctctccgatatcaacctgaccatcaaaccgggggagaaggtggcgttagtggggccgtccggaggcggaaagaccacgctgtgcaatctgatcccgcgtttctatgacccaacggagggggagattctgctggatgggcagaacatccgaaacgtgacgctggaaagcctgcgcagtaatgttggcgtggtgcagcaggacgtgtacctcttctccggcagcgtttacgagaatatcgcctacggcaagcccggagccacccgggaggaggtcgtccgggccgcgaagatggccggagcccacgagttcatcgagggcttaaaggacggctatgacacctatgtgggcgagcggggcgtcaagctgtcgggcggacagaagcagagaatcagtatcgcccgggtgatgctgcgggcgcccaagctggtggtgctggacgaggccacggcggcgctggacaacgagagcgagcacctggtggcggagtcgttggacaagctggcggcggggcggacgaccctgaccattgcccaccgcctgaccaccattcagggcgcggaccggattctggtcctttcgggcagccggatcgtggaggaaggcaatcatgataccctgatgaagcagcgggggatctattaccagctgtacacctcggccaacatggcggatcaggaggcggcagagtaaacaggaagttgatgcaggaccggcccgatccggctgcccgaaaggccgcattagaggatcgggcggatcaattatagtaaggagagacaaagttcattatgagagtagcgattgttaccgacagtaacagcggcatcacccaggagcaggggacggagttaggtatatccgttctccccatgccgtttatgatcgatggggagacctattttgaggatattgatttgagtcaggaggagttctatcagcgcatgaacgccggtgcggacatttccacctcccagccttcgccaaaggcggtgacggacctgtgggatggcctgttaaaggattacgatgccgtggtgcacatccccatgtccagcgggctcagcggggcctgccagacggcctgtatgctggcggaggactatgacggccgggtgcaggtggtgaacaaccaccgcatttccgtgacgcagcgccagtccgccctggacgccagggacctggcggcgaaggggtacagcgcggaacagattcgggagattttagagcggacccacagggattccatcatttacatcacagtggacacgctgaaatatctgaaaaagggcgggcgcatcacaccggcggctgcggctctgggaacgctgctcaagattaagccggtgctcaccatcgacggcgagaagctggacgcgttttccaaggccagaaccatcaagcaggccaagctgaccatgaccacggcgctggcccacgacctggaggagcggttcttggataaggaggccaggcacacctatttacagtttgcccacaccttaaacgacgcggcggccagggagtttatggactccatcatggagctgtatccgggcacgccggcctatatggaccgccttcccttaagcatcgcctgccacatcgggccgggcgctctggccatcgcctgcaccaaaaagctggaggagctggaatagttgaaacaaggtaaattgtgggaaaaaattaaggcatacggcctcagcatacgcctacccctggcggcgattgtgatcgtcctgggggtggtgccgctttttatacagggaaaggtgatgctggggtcgtttcagcaggcgcagttggatgccagaagcattgagatccagaaccagtgcgtgattctgagcaataagatgacgcggctgggttatatggccgccgagggcaaggacaacggtcagatcgagacgcagatgcaggcgatcgcggatattttcaacgggcgcgtggtgctggtcaaccggaatttccgggtggtgaaggacacgtttaatctggcgggcggtaagttttacatctcggaagaggtgatcaagtgctttaaaggggagaacagcagccactacaacaagcagatggggtattttgcccagacgatcccggtttacgacccgcagtcggataaaaatatcgacggcgtgatcgtggtgacggcttccacggagaatatcagcacgctgacggacctgatggaggggaagatcaactttttcctgatgtttgccatggtgattctggtggtgctggggctgaccctggtgtacatggtgtttggccccttccggcagcttcagaaggcctttgaccgggtggcacagggggacctggagtccgacatcacggtggacacctaccgggagaccagcctgctcagccaggcggtgaagaagtccctgaccaagctgaaggcggtggaccagtcccgccaggagttcgtttccaatgtgtcccacgagctgaaaacgcccatcacctccatccgggtgctggccgactcgctgatgggcatggaggaggtgccggtggagctgtaccgggagtttatggccgacatttctgatgagatcgaccgggagaatcagatcattgaggacctgctgaccctggtgaagatggacaaatccgcggagagccagatgaacatcgcccaggtgaacatcaaccggcagctggaaatgattttaaagcgcctgcggcccatcgccaagcgggggaacgtggagctgattctggagagcatgcgggaggtgacagcggatgtggacgaggtaaaaatatccctggccatcaccaatctggtggagaacgccatcaagtacaatgtggattcgggctgggtgcgggtcacgctggatgcggaccacaagtatttttacatcaaggtggcggattccggaatcgggattccggaggatgccctggatcacattttcgaccgctttttccgggtggataaggcccggtccagagaggtgggcggcacgggcctgggactggccatcaccaaaaatgtggtgcagatgcaccggggcgtgatcgacgtggagagcgtgcccggggagggaactacctttgccatgcggattccgctgacgtatattgtgagacaggagaccagaccatgagagaaatgttcagatggacgaggcctgtgaggtatctgtgcctgatcctgtgggctctgtccgccctgctgctggggggctgccagcccatgccggacgaggagaagccgctggaagagggggagtacctggtgtattatctggattcctccaccacccgtctggcgccccagccctaccggccccaggctaaggacgcggacggtatcatcgcggagctgatggagcagtttcaggaggttccggcggatgtggacagccagccggcgctgtcggacaaggtggttttccagaaattcacccggaaggatcaggtgctctacctgtattttgacgccaattacaacagcatgaagccggagcgggagatcctatgccgggccgctctgaccaagatgctgactcaggtggatggggtggattacatcaatatctactgcgccgaccagccgctgatggaccgcagcggaaatccggtgggtatgctctccggcagcgattttattatgaataccagcaatgtgaacgcctacgagaagacggagctgaccctgtattttgccgacggcgacggcggcaggctggtgcaggagaagcgggaggtggtgcacaacatcaatacttccctggagcagctgattgtggaacagctgatcgccgggccggagcaggaaggacattttgccacgctgcccgcggatttgaagattctgaatctgacggtgaacgacagcgtgtgttatatcaattttgattccacgtttttgaatgtgaaaccggagttaaatgagtatatccccatttattccatcgtgaattcgctctgcgagctgaccacggtcaccaaggtgcggattctggtgaacggctcccaggacgtgatgttccgggacgtggtgtcgctgaacgccgcctttgagcggaacgaggagtattccggggaaccacagtgagaggagaatgacaattaaacggccgcttcttggattagcagggagtttcgtacttggagaggtattggctctgctggatgtggctgcaattccatggatcaccggcgcttttgccgccgcctgcgcggcggcggtgcggggaaaatggagggcaaaacggagattgaacggagccggggacggggcgcgaagcgccccggccccgggcctgcggcggagcagaggcactggatttggggtgcttctgctttttttggctgcgcttctggccggattcggccgggcccagggagtccgggaccggctggacggggaggcggcctgggccggtaaggctgcgggtgtgaaggtgagtgtgaccgggaccgtggagcggatggaggagaaggaggatcaaacagagctgtggctgcgggacgcggcggcgaaggtggggagagaggggatggcgtttgggagggtggtggtgtatgcggattccggcgcagcggttggaatcggctcggcggtcagcctgcgggggaagctggaggcggtggagagagccaccaacccgggcgagtttgatttcgcccgctattaccggtccaagggcgcggcctgccgtctgtacggggaagaagtgacggcggccgatggggagacggcgccgtatttcgagggcatacggcgttttcggttgtggtgcggcggagtgctggagggcatctgcgagcccagcgatctgggcgtgttcaaggccgtggttctgggggaccagtcctccatggaccaggggatgaaggatatgtaccgcagccacggcatctcccatctgctggcggtgagcgggcagcatctggccattgtgggcggtgggatttacctgctgctgcgaaaggcgggaatgaaccgggggcgggccggtatgttggggggcgcgctggtggtgagctatggaattctcaccggaggctcaggttcggcgctgcgggcggtggtgatgattttatgcctgtggctggcgggatatctgggcaggagctacgactgtctctccgccatgggccttgccggaatgtggttattgtggcggcagccctatctgctgtttcagagcggatttcagctctcctttggcgcggtctgggccatcggaggtctgggcggcctgctgaacgaggcactgggggcggaaaaaggatggcagaggacgctgatctgcagtttgtgcgtgcagatggttctggctcccgcgacggtgtggcactatttccgctatcccatctacggacttgtgctgaacctgctggtggttccactggccgcgatactggtgtattcgggaattttggggattctgctgggcgggatctgcccgcctgccggagtgctggccgttggggccgggcattatgtgctggcattctatgagcggctgtgcgggctgttttccgggcttccgggggacagcctgttagttgggcggccggggtgggggcagattttgggttatggggtggtgatggcggcgggggtgggattggtggtgaggaggaaaacgatgggaaggccagcgggtaaaacggagggaaagccgccaggctttcgctggtgcggtctgctctccgtatttctgctgtacatagtttgtttctgcgtcctgttgccgcggcctcaggccgggctttccgtggcctgtctggacgtggggcagggagacgggctggtattcacctgcgcggagggcacggtgctggtggacgggggaagcagcagccggagcgggctgggggagcactgccttaagccgtatctggagagccgggcggtggaaacggtggattacgccatcgtcagccacggggattcggaccatgtgagcgggcttttggaactgatggagggcggcggcgtgagaatcagacgcctggtgcttccgcggatggccagagggaaggaagattatgccgggctcgtccgggcggcaggaggctgcggggcgcagatcctctacatggaggcgggggatgggatcagcctgggggaccttcggttcacctgcctgtacgcgggcaatcccgcgcaggagacggacgcggacaagaaccggcattccctggcggtgcgggtctcctacgggcagttcgggctgtttctcaccggggatatggacgccagctgcgaggccggactgctacgggcctgcgggcccggggatctggccggtatccaggtgctgaaggcagcccaccacggctcggacacttccagcagcccggaatttttggaccggctggggccaaagctggttctcgtctcctacggcaatgggaattcctacggccatccgtcgcccaaggtgctggaacggctgcgggagcgggggagccgcatcctggagacgggaagatgcggggccatcctgttgtggaccgacgggaagcgggtggagtgcagggggtggctcaagcgataggtgggggcccgcttgtttttgccggtgccatccactataatgaatcccaaggagggaggtagggatatgtttcacacagtagaggacgtgctgaggctggagggatttgagggcgtgcgtctggtggcgggccggcgggggctggggcgcaccgtcaccagcgcgtccctgatggaggtgccggatattcttccctatgtggaggaaaatacgctgctcatcaccacgctgtatcccatcgcgggaagcagggaacagatggaacagttgattccggagctgggaagccgcggggtggcgggcatctgcatcaagcccctgcgctacatcgaacagataccgccggtgatgatcagccaggcggacgagctgggattccccattgtcgagctgcccatgggcgccaacctttccaccctggtgaacctggtactttccatgtcgctgaacgattacatttcccagctgcaatttcgggacagcgtgcaccggaatatgatggagatgctgctcagcggcgcggaggtggaggagctggcggaaaagctggcggagcttctgcaaaaggacatcgtgctgctggacaaccagctggacagcatctgcgcggcgctgcgtggggagggagaaacgggctggaccatttaccgacgggaggaggcggaccggattctgaagggattgaggctgtttgagaatcattacaccatgcacccaatcaaggcggggaacaaccgcttcggcttcattttcgtgccggactcagagaagagcgacgacaacttaaagatggccatcgagcaggcggcgctgctgttcgcctcggtgtttttcaagaattacgcggtgacgctgaaccagcgcaatttcaaggatgtgttcatccgggacctgctgcaggggaagatccgctcggagatcgagctggagaacaagatgagggcctttgacgtttcactggcatttccccagtatgtggtggccatcaagctgttcacggacaatgaggtgatgcgcaagcacttttacaacgagctgatcgaccagaatctgatcagcaagcggatggcttatttttaccagcacatccgcaaaaagaacagcgtctatttcaacgactccattgtggtgattgagaacgaccagagtgaggagagtgtgaatgagttttacagccaggtgatcgggaagctggaggcagaggccggggagaattccaagatcggcatcggcatttcccgggaggtgaagaatttttccgagctgaaaaccggctaccgccaggcggttcacgcggtgagggtgggaaatattctgtaccgggattcttttatcagccggtacagcaaaaacggcctgtttgagctgatcgagcagatcaacgacacggatttattagtgcgtttcgtgcgggaacggctgggcgcggtcatcgattatgaccggaacaataaggccagcctgatgcagaccctggaatatctgatccagtatcattttaacctgaaacaggtttccgaggcccgatacctgcactacaacacggtccggtaccgggccaacaaactgcagcagctgggggtggacctggagccgggggaggggctgggggagattatcctggcgtatcgaatttatgtatggctgaaatcaataaaaaagatggaataatcagggggccaaattgtgatccggtgacaatttggcccctcttcgtttgtgtaccagcgacaatgacagagcttcggccggatgctatgattaatgcacaaggcttgttctgtacagacaaataaaacctgagcgaaataggaggcaacagtatgaagattgatgtgttcaagattgagatgtcggcgcccgacgatgtgagggagctgaagaagctgatcgatgcgggggaagtcgatccgggagagatcattgcggtgctgggcaaaaccgagggaaacggctgcgtcaacgactttacgcgggcgctgtccaccgtttcattccgttccctgatcatggccgaaacgggctggagcgaggccgaggtgtcgaagaaggtggccttcgtgatgtccggcggaacggagggggttatgtccccgcacgcgaccattttctgcaagcatgaggacggggcggccggaaccggagagaaacggctggcggtgagcagcggttttacccgggatttcctgccggaggagcagggcaccatggccgttgtggaggagtgcaggcgcgtgaccctggagctgatggcggaggcgggcatcgacgatcccgcggacgtgcattttgtgcagatcaaatgcccgctgctgacctcggagcgcatcctggatgccaagagccggggaaaggacgtggtggtgcacgatacatacgagtccatgggctacaaccgcggcgcatccgccctgggcgtggccatcgcgctgggggagattccggcggaggcggtcagccaggagacgatctgccacgattactccctgtactccaaagtcgcctccacctcagccggcgtggaactgctgaactgtgagattattttaatgggaaattctgtaaattccaccagcaactaccggatcggtcacagcgtaatggcggacgccattgattttaaggcggtgatcgaggccatccagagcgcgggtcttgaggtggacaagtatcccaccgacgaacaggcgaaggagatcgtcaacgtgttcgccaaggcggaggcggattccaccggttatgtgcgcgggcggagaaataccatgcacacggattccgacatcaaccacacccgtcatgcgcgggcggttgtaaacggcgtgatcgcggccattgtcaacgatcctatggtttatgtgtccggcggagccgaacatcagggccctgacggcggagggccggttgcggttatcatcaagcggtagacggggaggctatggactattattttaaaaatgcgaacctgatcctggaggggatcaagggggatttcgcggtggagaagggaaaattgcattttcacgggctgaaggacccggagcggtatgatcaggtcacggatttgcaggggcgcatcgtgctgaagggcttctgcgacctgcacacccatctggacaaggctttggtcagctcccgggtggagaaccgcagcgggacgcttaaggaggccatcgccgtgatggggccctataaggcgggtatgacggaggaagatatctacggccgggccagggaggcgcttttaatgtgctggtcaaagggcacccggtatctgcggacccatgtggacgtggatgagcagacgggcagccgcggcgtgctggcgctgaaaaggcttcagcgggaatttgcgggccgggtggagattcagatcgtggcctttccccaggaggggctggtgaaccggccgggcaatatccgggcgctggaccaggcgctggcggacggggcggagcttgtgggcgggattcccgccgcggaccaaaatccccgggagcacatcgacatggtgttcaccctggcccagaaatacaatgtggatgtcgatatgcacatcgacgagacggaccgggcggagtgcatgactctggaactgctggcggacgccacggtgcgcatgggatggcagggccgggtgacggcgggacactgctgcagcctggcggccaacccgccggagcgggcgggggaggtgctgcgcaaggtgagaaacgcgggggtgcggatcgtctcgctgccctccaccaacctgtatctgcaggggagaggggattcctacaacgtccgcaggggcatcgcgcccatcggccgcatcagccgggagtttcagattcccacggctgtggcctcggacaatatccgggatgtgtttaatcccttcggcaacggcaatctgccggaagaggcgctgatcgcggcccacggctgccatatgggcggtacggaggggcttgggctgctgttcgacatgatcagccgccagcccatggagatgttcggcgtcaacccttacctgcgggagggagacgaggcccgctttatcatctgcgacgcccgtacggcagcggaggtgattgtgggacatgaaaaactgtttgggagttttacaaataatcgaatggaggtgtagtttgtgcagcttttacttcacttgattcccattgcagtgatccttgtgatcctgtttatgaggaagcacatgctgtttgccggtctctgcggcgctgtgacagctatgattatcgggggtatcgcgcctgtggaggcgggaaatatggtaatggagggcatcggcaccatgttcagctatacggcgccgatcctgtacgcggccgcggccgtgatggtgtccaagggcggaagtatccaggccatcgtggatatcgcccagcatgcgctgaaaaagaaaatcgccctgtttgcgggctttctggtgctgatccaggcatttgccacctacatggccggtatgggtgccggaaataccatggtaatcgcgccgttagttgcggcggcggtgggagcggtgccggaggtaatcgccggtatggccatcgccacggcggtgggctttaccacctccccggcctccacggaaacggttctggcggctgaggccgcgggccgggacgtggtggagcacgcctccagcatgatgccggtgaccatcctgttcttcctgctgggagcggccctggccgtttacggcgtgtataagcgggggaccatgattgtgaagcgggagaaggaggaggagcagcaggatcagctcaccacggggcagctgtgggtgcgcgcggtgccggccatcacgctgctggttctggtggtattcggctccaagttaaacaatctgatcgggattcatctgtttgttccggccatcaacgtgattatcacggccgtgctgaccgcctgcctgacgccgcttaagatcaacaagacctgcgacgctctgggcgagggatcccgctatattttgaccactctgttttctgttggctttttcctggcattcatcaacattatcgccaagcttgggacctttgaggagctggcggccctggtgggaaatgcaccccaggcggtaatcgtgccctgcgccatgatcatgggctttttgatcgcaattccgtcgggtgcgttctgtgccggtgtgctgacgctgattctgccaaccctttccctgttggggatgccgtcggaggccatgggctttgtggccatcgccaccggcttcggcacccaggtcagcccggtgcagatcaatatcgccgcgctttccgagggatttaaacaggatattatgaaaacggtcaggagcaacatcaaatttgtggtgggagctctgatcctgctgatcgtgctttcgttcttctttgtgtgatcgggtgttactgacggcggcagcccgccttagggacgggctgcttccattcaatgtaaatgggtatgaaaaggagtgagggtgacgaaatgagtggagagacgaagcgagcggatattctctataacatcgatgacaggccgcctgtgggaaagagcgtgatatttgcgttccagcatatcctggccatgttcgccggaaatgtgacggttcccctgctggtgatcaacattgttgggttaaacagcgaggagggaacgtttctgatccagtgcgccctgctggtggctggcgtggccaccctgctgcaggtgagaggcataaaggcggtgggatcccgtctgcccatcgtcatggggaccagcaatgcgtttttgtccaccgtggtggccatcacctcccagtacggtatcggggcctgtctgggggcaagctttatcggcggtctttttgaggcggtgctgggcaattttatcggccgtctgaaaaagatctttaatccgctggtatcgggcatcgtggtcatgaccatcgggatcacgttgattcccaccggcatgaagcaggccgcaggcagcaagaccgccgccggtctgggcgcgccggtgaacttgctgctctccgggctggtgatcctggtgatcgtcctgtgcagccgcagcaggaacaagacccttaaatccgcctcaattctggtgggaatcgtggtgggctacgtggtggccgctgtggcgggcctggtggatttttccgccatcggtcaggcggctgcgttctcggtgccgctgccgtttcgctaccgctgggaattccactggtcagccattgtggctatgctgtttatgtatgtggcaaccaccgtggagacggtgggcgatatgaccgccctgaccgtggtggcgcagaaccggcagcccacccccgaggagagccggggcggtattctggccgacggcctgggcagctccctggcggcggtgttcaacgcgttccccaacacctcctacacccagaacatcggcgtggtcaacttaacaggcgtgttcagccgcagcattgtgaacatcggagcggtgattctggtgggcatgtccctgttccccaagctctcagccgtgatcctgtgcgtgccggagccggtgctgggcggagcaacgttaatcacctttatgatggtgtttatctccggcgtgtccctgatcaccagcgtggatttgggcagccgcaacatgctgattatggcggtgtccctgggaatcggagtgggcttcagcctggtgccggacgtgaccaaagtgttcggggaatcggtgtccgtatgtctgaataacgggattgtgccggcctcgctgatcgctatcgccctggactggtttttgccaaaggacgggaatgggactgccggggaggaagagatacgggaagcgcagtgatccgccgggatgcagtctgccgggccgcgcttcgggtgtgcgatccgcatttccgggcgtttgtagaaaatccccgggggcaggtgcacagcgtctatgagagagcgtttaatctgtgggacggatcggatttgtacgcggtggtggcgggcgcgtgttacgctgcgccgtacaccggaaatacagatggagatgttttttgggggcagctggtccgcgtgggagacgcggtggagggccggtttccggtgatccgcatcggaagcgggctggtgctggactgcagccgggtccgggtgaccggcgaacggcagtggacgcagcgggagtgggggacggacgggggaggagagctcccggcagggagtgcgcaggagcgcgcgcaaaatcttgcctccggaatctcgcgctaccggcagtatttgcaaaatcaggatatccgaaagggctgcgcctattttttccgccgcgattgttccggggaggttctgcccggtccggggattttgcaggaggagatgaaccggcgtctttgggcgcttcttaggtcggccggtgagccggaacggtttgcggccgccgggcggaagctggtgggggccggtatggggctgacacccgcgggcgatgattttctgtgcggtatgctggcggcgctgaactgctgtgagagcaccgcctcgctgcgggccgctctggcgggagggttgaaccgcccggaaattcttgcggccaccaccgcggtgagccggcaaatgttgaaagcgtatttaaacggggaaaattccctgttaaatcgccgcctggccgcctgctttttgaccggggggcgggagatggaagagattatgaaactggtggaagggatcgggcattcctccggcattgacttttcggccggtttggccgccgggttttgcctggtcctgaacagaattaaaacgataactggggtaacggcatgtacaagaaaacaataatcaagcccaatacatactatgattccgtgacgcttatgtcccttggaagtaagataaaagcggtggaaggtgtaaaagaggctgtggtggtgatggccaccgacatgaataaagagattttgatgaatgtgggcctgggaaacgacgagacggaaggggcgacgcagaacgacctgattatcgctgtggaggcccgggacgaggagacctgcgtggaggcccaccgcatgatcctggacaagctgaccaagggcagcggcgcggccgggcaggaggcggaggtggagtataagacgatccgccatgcagtgaaggacaaccgggcggccaatgtggcggtgatctcggtgccgggccggtacgcggcaagggaggctaaaatcgccctgaacagcggtctgcatgtgatgatgttcagcgacaacgtctccattgaggaggagcgggcgttaaaggagctggcggtttccaagggacttctgatgatggggccggactgcggcaccgcggtgatcaaccacaccgggctttgctttgccaatcaggtgcggcggggaaatatcggcgtggtgggcgcttcgggcaccgggcttcaggaggtgatcgtgcagatcgaccggctgggcggcggtatcacccaggccctgggcacgggcggccgggatttgagccgcgagatcggcggactgatgatgctccacggcatccgcaccttggcaaaagagccggacacggagatcattgtactggtctccaagccgccggagcagtcggtggcggacaagatattcgagctgcttaacacgctggaaaagccggtggtggtctgcttcctggagggggacaccgccagggattgccgggagggcgtttatctgtgcgataatctgctggacgcggccaggacggcggtacagctggccggagtggcgcaggacgcgggtcgggaggaagccagggccgcgcggttacaggaggcgattgcgagggccagggaactgctgcagccggggcagagaagcgtgcggggcctgttctgcggcggcacgctgtgcgcggaagcgctctttgtgctgcggggacgcctgggcaagatccggagcaatgtgtcccaccgggacggggagaagatcgacggtaaggaagcctgccgcggcagcgtgctgctggatttgggcgacgatgaatttacaaacggccgtccccatcccatgatcgagccttcgctgcgcaacggcaagatcgcagagcagggggatgaccctgaggtgggcgtgattttgctggatttcgagctgggatacggctcccaccgggacccggtcggcgagacggtcccggcgatccgggaggcgagagcgagagcccgcgcccaggggagagagctggcggtggtcggctatatctgcgggacggcggcggacaaacaggatttgtcagggcagagggcggctctgcttgcggaaggcgttattttggcggagagcaacgtggaagcggcccagacagccgcagacattctgctgtgacggaggaggtgagtcttatgaatcggaccaatgaattatttcaggaacagttaacgattttaaatgtgggcgcgcccaatttccgggaggatttaaagctgcaggggcagcaggtgacccagatcaaatggcagccgcccatggacggggatcaggagctgctggagcttttggaccgctattccttcgacgatggggtggttgaggcgaaccggaaggctgtagacatcgtgatgagcgccagcccggtactgatcggcattgaaccggcttacaaggtggtgccggggatgacagaggacaccattctgcactcgggtccgcccatcacctgggaccatatgtgtggaactatgcagggggcagtgatcggggccttgctctacgaggggagagccgccgacgagggggaggcgaggcagctggccgcctccggcaggatcacattttcaccctgccatgagcacagcgcggtggggcctatggcggggatcatctcgccttccatgccggtgcacattgtggagaaccggacaaacggcaaccgggcgtactgctcggtgaacgaaggactggggaaggtgctgcggttcggcgcgttcagcagttccgttctggagcgcctgaggtggattgagaaagagtttgccccggtgctgaacaaggccgttgagatggccggaggggtggatttgaagctgattacggcccaggcggtgcagatgggggacgagtgccacaaccggaataaggcggccaccagcttatttttcaaggaaataacgccttttatggtgcagagcggttatcccatgcctcaggtgttaagggccatcgattttatccgctccaacgaccactatttcctgaatctgtccatgcccgcctgcaagtcctccctggacgcggcctgcggtgtggagcgctccacggtggttactgcaatggcgcgcaacggggtggaattcgggatcaaggtcagcggtctggggaaggactgttggttcaccgcaccggccaattttgtggaggggttgctgtttccggggtatggcccggaggacgccaacccggatctgggggacagcgcaatcaccgagaccatgggaatcggcggcttcgctatgggggcttccccggcgatcacccagtttgtgggaggaacggtctccgacgccatcaactatacccgcagcatgtattccatcacaactgcggagaacaacaattattcgctgcctccgctggatttcaaggggacggccacgggcatcgatattctgaaggtgctggagacgggaattattccggtgatcaacacgggcatcgcccacaaggttccgggcatcggccagatcggcgcggggatcgtacacccgcccagggagtgcttcgtgaaggcgctggaggcatttggcgaacgctatggagacggaaacaagggggagtagacgtgtgaataagaggattgtgatcgccctggggggaaatgcgctggggctcaattttcaggatcagatggcggcggccggacgggcggcgaagatcattgccggtctggtgatggacggctacgaggtggtggtgtcccacggaaatggccctcaggtggggatgatcgaccgggccatgggtatgctggccgccgaagagccggatctggcccaggcgcccctctccgtgtgtgtggcaatgacgcaggggtatatcggctacgatctgcagaattttctgcgcgaggagctgctgcggatggggatcgacaagcccgtgacgtccctggtgacccaggtggtggtggaccggtcggatgaggccttcgccaatcccacaaaacccatcgggcggtttatggaccgggaagaggcggcagcgtgggagcgccggggctgccgggtgatcgaggactcgggccggggctaccgccgggtggtgccgtcgccaaagccggtggatattgtggagattgagacaatccgcagcttgctggatggcggtcaggtggtggtggcctgcggcggcgggggaatcccggtggtgcgggagggctgcagcctgcggggcgtgagcgcggtgatcgacaaagattttgccagcgccaggctggctcagatgattggggcggattacctggtgatcctgaccgcggtggaacgggtggccgtaaactatgccaaaccggaccagcggtggctgtcgtggatttccgtggaggaggcccgggcgtacatcgcccaggggcagttcgcgccgggctccatgctgccgaaggtggaggctgcggtggagtttgcgtcatcgctgcccgggagacgggcgctgatcacgctgttggaaaaggcgggagaggggcttaagggggagacagggacggtgatttgcgcctgaggttttgagggggagaattgggggatggagaaaattaaacgtgccgctttccggtttttgggggaagcggcacgctttttttggaggggtgggcgggctggttgtgtgtggtgtgtctgggggtatagatggcgggaatgaatttttagacaggcctgccgggccgggaggcgaggcaggcgggggaacggactgatggatgtctgcgttcgggtacaggcggttgggccggaggctatttggattttttggagaagtatggtttctgggaaagaatgtgatccagaagcgcgttgcagccctccagcacgtcgtcgtaggctgtgtcgaaatctccggtataccacgggtccgccacatcccttgggtggtctgtgaaatccagcaggcgggataccttgccgtcgggatcaccgcccaggatgcgcagcatgtcggtgatgttgtatcggtccatgccgatcaggtagtcgtacttgccgtagtcctgcttttccaggcgcacggcgcatttcccggcggtggagatacccagcgcctgtaacttggcgcgcgttccgcggtgtacgggattgccgatctcctcacggctggtggccgcggaggcgatgtggaatgagtctgagaggccgcgggtttggattagatggcggaggaggtactcggccaggggggagcgacaaatgttgccgtggcagacgaaaaggatgttaatactattttgatattgcttattcatatactatatctccgttactttttgatagctaaagtctactataagttcaagctttgaacaagggtttctttttattctcctatttacagccggtttaccgtcttgtataatggagacaggcagttcctactgctgggtgacttccatctccgaaagggggtggtataacatgagtacatatgagacactttctttaatgattgcgtttggagtacttatcgttatgattataggtacaaaaaaatagtcacccgccctccaaagcaaatgtgactattttttgagttaaaattctttggaagccactcactggagtgaactgccttttttgtacctttattataaactaaatttggtttatctgtcaatcatgatttttcagcgcttttcttgcatttactttcgtatacattcaatcctattggaatgcttcgtagcatattgccgtggcagatgaaaagtacctttatattattctgatgttgatgagtcataaatcgtttctccattcgatttttgttagataaagtctactataaatttgtccaataaacaagagctggtttccatttgtattctttacaggcagttaatcctttagtataatgtgtataggcagttcctactgctgggtgacttccatctccgaaagggggtggtataacatgagtacatatgagacactttctttaatgattgcgtttggggtacttattgttatgattataggtacaaaaaaatagtcacccgcctcccaagcatagtgactatttttaattaggttataaacttggaagccctcactggagcgaactgcctttttgtacctttattataaactaaatttggtttatctgtcaatcatgatttttcagtgcttttcttgcatttttcagcctttctcccacattttcccgtccacattcctcagcttttttaatcccgattgaaacaaacgattccgtttctccgtcaactcgctatcttcttccagccatacatgaaatataatatctctgtctctgctcaatatttcaataaattctcttgcggtataaatagcgttctgatccagttttaactgatcaatcagccttgaatctaatgcctgattgtatgtatccttacaatgatagcctctgatgtgatccaaaggatcgctgcagcgggaatctttgaatcggttacacggtctgcaaatatcatccccataaatggtaaactgcaattccgtgtccaggttttcaatcataagattcgcaactttatagaagtcatgctgatacaattcatccggcacaaagtgctcaacgcctgctccataaagtttaatgatatcgattagatgatggggtttaatgacaatcataaaagtctcctataaattacgattttctctggtctgacttaactccataaaaaattgttgtcgtcagtcccacaagtccgatcgttaatgtgaatatctccatcccagcactacattgctgcaatagaatcgcaaacaagagaatcgcaatgccaatcaaactttttttcatttcaacttctccgttcaccccaacaacttcttcaccatctctccgtcaaatcttacctcgcgcacgccgtccacctcgatctggtaaagggcgttggcggccagatgctccgcggcctgctccaggtcgcggatgccggtggtgtccgcgtattttccgatcaccgcgtccagggcctcatcggtgatgatgcattcattttcatgcagactcatgcgttttaataccttgggcagggaataccgttggaagataattttcttttcctccgccgtgtagtccgggatatcgatcaccgcgaagcgggacataagcggcgcgctgatctggcctttgtcgttggcggtggcgatggggtaaacgcccacggtgggaaccatgcactcgatgtaattgtccgtgaagcccagattgtccagcagggtcagcagcacgtccgctggattgccgtttccctttccggcggcggccttgtccagctcgttgatgataaacaccaggttggactcgcccgccatggagaatgcctccatgataatgccgggttttgcgttggcgtagatgcgggaactgccggtcaactgttccgggtcgttgatggagctcatgtccagggtggtccacggcagcttcaggatgcgggccaccgcgtaggcgatctgggactttccggttccggcggggcctaccagcagcaggccgtaggcaggcagcgtgtgggtgcggttgatctggatgatggtctcgatgatccgctgcttgacccgctccattccgtagagctcctcgtccagaatccggcgcgcctcctttggatcaatggcttcgaaataattgcttttccactggatattcatcataatggacagggcgcgctgggcgtgacgccgttcctcgggggagacctcatgggagcgggccaccgccaggtttctgcgggcccagaggcggatgttgtcgggcagggtgcggcccgcgcaggtcatgaagtccgtgatgctctgcaggctggtgagcttcatgtcgtcgccgtcctccatctggtcctcgtcctcctgctcctccgtgggcgcgctgctggcaaacagccggtcgatcataaactggagaaatccgtcctcagccgagagcttagttccgcccccgaaggcgatttcacggatccggtagaccgcgtagccgttttcgcggttctcgccggacaggcgcacgttgatgtggttttcccccagccaccggagcagactgacgaagcgggcatcgatctgtaaaatatcggcgctggccgtgccgtcctcatccttgaactcaaaggcggtgcgcttgatgggattggtaaaaagaccgcaggaatggtgcttccaggcccgcttccggttgtccagcaccagaatcggctggtcgggggaagcggtggcgtggctggactggtatgtggtgtaggtacactcggacggtgcgttgacctccgatgcgtcgttgaaatcaaatactggcatgacggatactcctttgtggattttagtagacaagaatagctacgtttcctcgttatactttgtcatcagccgccaggctgatgatcagcattacgtttcctcgttatactttgtcaccagccgccaggctgatgatcagcgttacgtttccttaattatactttgtcatcagccgccaggctgatgatcagcactacgtttccttattataccaagacaacggctctgtgactagccgtcgcagcaattattttgcatttttattcatttttaattcacaacccgatcccattgctcttcccgccctgccggtgttatactagacagatcagaaacctttatcatttccaaaaaggagttaagccatgcgaacaatctacacaaacggagccgtgtacaccggagcgctgccgctctgcgaggcgtttgtccaagagaacggccgttttctctatgccggcggcacggaggaagccatgacctatcggacggccgaaacgcgggtcgtggacctggacaagcggtttgtctgcccggggtttaacgattcccacatgcacctggtcaatttcggatatttcctacaggcggcggacctgagccgtcacacctcgtcgctggcagaggttcaggaggagctgcgccgtttcctccgggccaacccggacccggcaggtggatggctgcggggccggggctggaaccaggactattttgccgatatgaaacgctttcccaaccgctacgacctggaccaggtgtcaagggacgtgcccatctgcattgcccgggcctgcggacacgcctgtgtggtgaattcccgggcgctggagatcaccggcgtcacgggtagtacgccgcagccggagggcggccgcttcgaggtggacgaaaacggggagcctctggggattttccgggaaaatgccatggatctggtgtataacttcatcccggctccggaccgcggcgagattaaggaaatgatacttgcggcctgcgcggctctgaaccgttatggagtgacctccagccagtccgacgatttcctggccttccccaacgtgccgtgggaggagacgcttgaggcgtaccgtgagctggagcaggaggggaaaatgacggtgcgcgtgaacgaacagtcccagttttccagcctggaggagctgaaacgcttcatcggggccggatacaacaccggatggggcggcagctggtttcgcatcggcccgctgaaaatgctgggggatggttcccttggctcccgcaccgcctacctctcccggtcctacgcggacgatccgggcacccggggaattcccatctacacccgggaccagttccgggaaatgatcggctacgcccacgagcacaacatgcaggccgcgatccacgccatcggcgacggaatcctggacgacgtgctggcggtttaccgggaagtgctggagcggtgcccgcgcggggaccaccgtcacggcgtggtgcactgccagatcaccaggccggatcagctggaggcatttcgggagttggggctgcacgcctacgtccagtccattttcctggactatgacatccacatcgtgagacagcgggtggggaaggagctggcaaagagcagctacaatttcaaaacattgatggactacggcgtccgggtgtccaacggctccgactgcccggtggagcagccggacgtgatggcgggaatccagtgcgctgtgaccaggaaaaccctgcgggaccaccttggcccctacctgccggaccaggccatgaccgtgcaggaggcgcttgattccttcaccggcgcgggggcgtacgcctcctttgaggaggaacgcaagggccggatctgccccgggatgctggccgattttgtggttttggagaaaaatccctttgagacgccggtggatgagcttgcaggaatcgccgtgctggccgcgttcgtggacgggaaatgcgtgtaccagcgggagaatcggcgctgacgcccacccttgcatttaaaattcccataggatataatagagtcgaacacagatacgggcgccgccactgcgcgcccgacgctgcgccaacaaaccagacgaggataagcatacatgcagacactgaatcaagacatcaaggaccgctccttcaagtccgcctacctgctgttcggggacgaggcatttctcaaaaagagctataagaaccggctgaaggaggctgtcaccggcggggacaccatgaactacaactattacgagggcaaggggatcaacgttccggagattctggggatggcggacaccatgccgtttttcgcggagaagcggctgattctggtggaggacagcggattcttcaagggaggcggggaggcggaaagcctggcggaatatctgcccaatatcccggacaccacctgcctgctgtttgtggagaccgaggtggacaagcgcagcaagctatacaaggcggtgaagaagtacggttacgcggcggagatggtgcgccaggagccggcgcagctggcccgttgggctgcgggggtgctggcccgggaggggaaaaagatcaccggccgcaccatggatctgtttctcagcaagaccggggacgacatggagaacattctctcagagctggacaagctgatcagctacaccctggggcgggacgtgatcacggacgccgacgtggaggcggtctgcgtcacccaggtgacaaataaaatttttgacatgattacggccatttccagccgtcagacgcgaaaggccatggacctgtacgaggaccttctgactctgaaggagccgcccatgcggattctctttctcatcgcccggcagttcaaccagattctccaggtaaaggagctgatgggcaaaggcatggacaagagcaccatcgcgtccaaattgaagctggccccctttgtggcgggcaagatcatgctgcaggccaagagctttaccaaggagcagattttttcctatgtgaatctgtgcgtggacgcggaggaagcggtgaagaccggcaagctggccgaccggctggcggtggagcttctgattgccaatcattattgaacaattacattgaacgcagaaagggaaaggcgatggatatgatggacaccatagaactaaagacaatcaaagagcaggctaaaaaggtggtggaagagcttttggaggcggcgaagctgcgggaaggccagattctggtggtgggctgttcctccagcgagatcgacagcttccgcatcggctcccactccagcggggagatcggccaggcggtgttcgaggccatttacgaagagttaaagaccagagggatctacctggcggcccagtgctgcgaacacctgaaccgggcgctgattctggaggaggaagccgcccggcgttacggctatgagccggtgaacgtggttccccaactgaaggcgggcggttcctttgccactgcggcttacgccggactcaatcacccggtggcggtggagcacatccgggcccacgcgggcatcgacatcggcgacacgctgatcggcatgcacctgcgggacgtggcggttccggtgagaatcgcgacaaaggagatcggttccgcccacgtggtctgcgccaggacgcggttaaaattcatcggcggggtgcgcgcccactatgatgaggagctgatgtaacgccaatcaatcgaaaactgaaattccggcagggattttcaaaggcattcaggggcctttgggaatccctattttttgttgcatgcaatgggctgccggcgcagcctgcaggcggttgttcgttttttttcttcacatttttttaatcccccggaaacgaacaaatcgggccaaagcgttgacgtggcccgggcggacggctagaatgtgcctataaacattgagacgggcccgtgaagtttataagaggagaagtgaaggattatttcctgaggaggtttactatgataaacacagtcattattgcggatgatctgaccggagccaatgacaccggagccatactggcgcagaacggcttcaaggtggggaccatcctgaaaacggatcacatggagcagtttgaggattacgacgtgctgtgcatcagcaccaacagcagagggatcagtgggacggaggcatacgccagggtgcaggaggcggccgtcctgtttcccagaagcgaatccattctgtacagcaagcgggtggactccacgctgcggggaaatgtgggagcggagatcgacagcatcctggattatctgggagaggattaccgggccgttgtagtggcctcctttcctggatcagggcgcacctgcatcggggacattctgctggtaaacgaggttcccctgcagatgacggaggtggccaaggacccgacggcgccggtacatacgtcgagagtgacagagatcatccggcagcagtccagacacagcgtgggctacatcggcctggagaaggtgctggagagctccgggaagctgttggaacagctgttggagaccgccaagcagcaccgcatcatcgtgatggacgcccgcaccgtgcgggacattgaggccattgccgcctgctgcgcggccagcgggcttaagatcgcggccattgacccgggttccttcacggcggccctggccggaaatctgtttaagcacaagaaagaggcgatccagaaaaagctgctgtgcggccttggaagcgccagcgacctgaccaggcagcagcttcagtacctgaagaaaatcgccaacccgctggtggtgcggatgaacgccggggaattcttccgggcggacaggcgcgcccgggagatggagcgggtgaaggaagcagttttgcgctcggaggagtcccacggcattctggtgatcaccaccacggaatccaaggaggacgtgctggatttgtccagcgtggacggggcggagcactgttccaagaaagagtgcgccggtgtgatcacggacaccatcgcccaggttctctacgacctggtgcaggaaatggacggacgggtgggtggcgtctacgcctcgggaggcgacgtggcggcggcattctgtgaaaagctgggaatctccggcttcaatgtgaagggcgaggtgattccgttagccatctattccaacaccatcggaggtgcccatgagggactgcccatgatcaccaagggcggactggtgggcagggaggacaccctgctgcagtgtatggagtattttgagaccgtgatctgattttatcttaaacaggaaggggagtgtgacatatggatgaaggtttgagaatggccctgggtctggcgctggggctggtgatactggtgctgatgattacaaagacgaagattcacgtgtttctggcggtgatcatctgttccatttttatcggactgttcggcggcatgggtcaggaggatgtgatcgcatccattacaaagggattcggcaattccctcagcagcatcggcatcatcatcggtttcggcgtgatgttgggaaaattgctggagatgtcgggggccacccgggtgatggccaacacgttcatcaagatatttggaaaaaatagggaggaagaagcgctggccatctccgggtttgtgacctcgctctccatcttctgcacttcgggttttattattctggctccgcttatgaaggcgctgtcaaaaaagacgaaaaaatccgtggtggccctgggaatcgccctggcgggcggcctggtggccagccattcgttggtccctccggcggccggtcccatcggagtggcgggaatcctgaatgtgaacatcgggcagtttatgctctacggcaccgtgctctccgttcccattattctggtcagcctgatttacggaaaatacctgggcaggaaaatctgccagataccggacggggaaggctggaccagggaatatgagccagggcagacgcaggctgagcccgaggcggcggcagcggacagcggtgccctttcgatctcgccgttgacggcgttttcgcccatattatttcccattctgttgattctgttaaagaccgggctaaagtcggccggcgtggaaaacggcgtggtttccctgctgggccagcccatcgtggccctggccctgggacttctgatcgccatttacgggctgatgcgccggtttggcaagagcgacaccttaaacgcgatggaagaggggctgaaggccagcggcaagctcatgctcctggtgggcggcggcggagccctgggaatgatcatccagaacagcggactgggggagtacatcgcctccaacattatcaaaaccagtattccgcccctactgctcccgttcctgatcgcggcgcttttgagagtggctcaggggtccgggtccgtggcgatgatgacggccgcctccgtggtggcgcccatgatcggaacgctgaacttgaacccggtgtttgcggcgctggccgcctgcatcggcgcaatcccattttcccatttcaacgactcctatttctgggtgatcaatgagtccatcggaatcagcgacaccagggagcagatgcgggtgtggagcgtgaccaccacgctgtcgggattcgcggcgctggcggtgctgcttgtgatgaaccattttctgggataactgaaaaccaaacagattttaaaaactggaggaaaaaagatgaaaccgattatattgattcccatgggagacccggccgggatcgggccggagattgcagccaaggcgctggcgcgtgaggaaacccttcagcgcgccagatgcgtggtggtgggggacagacaggtgatggagcaggcggtcagaatcgtggaccttcccctgaccatccataccataaacgagccggaggagggcaggttcgaggagcgcgtgatcaacctgatcgatctggccaacgtggatatggggcagttcaagcggggggagatcagcgcaatgtgcggccgggccgcctatgaatacatcgcaacgagcatttcactggcaaatgccgggaaggccgcagcggtgtccaccacgcccatcaacaaggagtcccttcgggccgccggggtgccctacatcgggcacacggagatattcggagcgctgaccggcacgccggacccgctgaccatgtttgaggtgagaaatatgagggtgtttttcctcaccaggcacgtgtccctgcggaaagcctgcgacatgatcaccaaggagcgggtgattgactatgtgaagcgctgtacccaggcccttaagcagctgggagtggaggacggaaccatggcaatcgccgggctgaacccccacagcggggagcacggcctgttcggggacgaggagatggaggccatctatccggcggtggaagagctgcaggcccagggctataaggtggccgggccggtgggagcggactccgtgtttcacatggcgctgcaggggaaatttaacagcgtgctgtccctgtaccacgatcagggccacatcgccaccaagaccctggactttgagcgcaccatcgccgtgacggcggggatgcccatcctgagaacctccgtggaccatggaaccgccatggacatcgccgggaccgggatcgccagcgacgtgagcatggtggaggccatccgccttgcggcaaaatattccccctccttcgtgagatagaaattaaaaattacaaaatatggatttttttggaaaatgccgggcgcagagattgtgtccggcattgtgtccgtggtattgacaggatgatggggaacgtgtaacattggcttaaatcggagatcggaagagaaaggcggggatgaacatgacggcggcagaagagcggcagaaccggattgtggagctggtcagcgagaagggaaatatccaggtggaccggctggcgcagatattggacgtgagccagatgaccattcgcagggatctggacaagctggaccgggaagggattatcgagcggcgtcacggcgttgcggtgatcaagcacgagaccacctacacggaaaagatggtgaccatgatggaggaaaaacggctgctggcggaagcctgcgcggcgatggtcaagccgggggacacggtgtttctggactcggggaccacgatctatgagattgccaagcggatcatggacattcccgatctcaccgtgatcaccgacgacatcgagaccggatttctgctgcaccgcagcggcgtggagctgatgatctgcggggggacggtgcagaaggagaccggaagtattttcggaaccttttccaatcagatgatgtcctatatccacgtggggatcgcgtttatgggcgcaatgtccattgacgccaacttcaacgtgctcacgcctacgctggacaaggcctcgctcaagcggatggtgaccaaaaacgccaacaagagttatctggtggtggaccactccaagttcaaccgccaggccctgatgaagatcaacagcctccaggactacacgggggtggttacaacgaagatttttgacggcagggagcgaaagcggattgaggagctgaaaatccaggtggtgacagtgggcggcgaggataaacaggagggttagagccgcctgcccggtatgcctgcaacgggcggatggggaaatggcggcgttttggccctgagcggcagcacttttgtgcgtttttttggatcaaaagggaatgcgctctgtacaaaaaggtctgtgttcagatacattaacgatattttgctaaaaaatactgaaaaagctgtaacaattttataacatactttatttcgtgaatctattgacaatatctggtacctgtgggtataatagccttgtgaatttggtcatctgacaaaatttcggataaatatcatttcgccttgtacagccaaactgaagggggcacaattattggatcaagtttcaagtaaagaagagcctacaaaagaagtgattttggaggcggcgctggatgtgattgaggacagggcaatcagcggtacacggctgcgcctgatcgccgagcgggcgaatctcttccaatccaacatccattactatttccggtcaaagcgggaactcctgctggccgttcagaaaaaagtgctgaaccgctgcattgagatcagaaacgccctggaacaggaagcgggcgattccctggatgcgaaactgaacgtgtttatccggcagaaaacagaatttatccgcaatatgaagaaatacgattacgcggagatcgatttctgggtccaggcccgcagcgacgaggacatccggcgggaatttaagcggtcctttcagaactggcgcagcgatatcaaggatattctgcggccgtacgccccgggggcaaaggaaaaagagctggatctgtgcgcggccgtgttcgtgtccctgttggagggtgcgacccttcagtacctgatcgatccggaggcgtttgacctggacaactatttcgacgcggccagggctgccgtcaaagacaggctggcgctgatctgcaacccaagtatttaaagcataacgctctaaataaataacctatttaaaaggagaggaactatgagaaaaatcacagcaatgatgttggcgatggcaatgtccgtgacagcccttaccgcctgcggcggcggagccaaggagacgactgcagcggcaacagaagcgccggctgattccaccgcagctgcggcagagggagagagcacggcggcagccgacacggcagcgccctccggagacgcttcttccttcaaggtagcggccattttcggcggagccatcaacgacggcaactggaatgagacacagtacaacggcttactgaacatcgagaagctgggcgctgagacctcctatatggagaatgtcagcgacaccgacgcagccgaggctgcccgtacatacgcttccgagggctacaacctggtatatctgaccaccaactcctatcaggactactgcacgcccgttgcgaaggatttcccggacaccatgttcgttcagatcaacggcaccgagatcaccgacaacttcatttccgtgcgcatcgccgacgaggagcagggcttcttacagggcgtggcggctgctctgctcaccgagaccggcaaggtaggcttcgtaggcggacaggagatcaaccccatcaagcttggttcctccggattccagcagggcgttgactatgtgaacgcaacctacggcttaaacgtagaagcacagcgcatcaacaccggaagctttacggatgtaaaccaggcaaaagagaccgctatctccatcatcgagggcggcgcggacgtgatcgcccccatggccaatgacgccagcaccggcatcatggaagcaggcgaggagaagggcgttatggcaatcggctgcggccttggccaggagacctccgctcccacagcaacccagctgatcatcgtaaaagatgtggcaatcgcttatgacgttacctttgacgctttcatgaagggcgaattaaaggcaaccgaggttgagacctacggcgcaaacaagggcgttgtgtatgcaaccgactggatgggcaccaaggccagcgacgaagcgaaggccagacttcaggagaccattgacaaaatgtccaagggcgaaatcgagatttctctccagtaaaccgcatatctaaatagcacaacttaagtgtcgtgacattcagggctgttcagagcgatttagtttctggcagccttgtttaaaaatataagtgatcatatttcggagggttgatatgcaaaaacggaatcttaacaaattgaaagagataagttttcccctggcctccattttggtcgcactgatcctgggtgcgattatcatgtctgcaatgggctatgatgtgggaaaagcgtattccagccttttaaaaggcgccttcggcagcaagaactccatcgccgaaactctgattcagacaactccgctgatctttacagcgttaagctatgccatcgcgctgcggtgcggcctcgtaaacctgggtgcggaggggcagttatacatgggagccatctgcggttccatggtgggagcccacatccagggacttccccctgtgttacatatcattctcgttctgctgtgcggcttcatcggcggcgctctgtgggggctgatcgtggccgtgctgaagatgaaattcggcgccagcgagctgatcaccaccattatgctcaactatatcgcgctggagttcgtcagctactgcgtgaccaatccgccctttaaggatatgacgcctggcgcggctccccgtatgccatcggtggtggacgcggtaaagctgcccattatccttccccagaccaggcttcacttcggcattattctggccctgctggcggtggtggtgtattacatcttcatgtggaagaccacccgcggctatgagatgcgcgtgatcggcatgaaccccaacgccggccgttactccggcatgaacattcccgtcaactccctgctgtccatgttcatcgcaggcggcttcgcgggactgggcggcaccatcaacattatcggactccagtatttcctgaccgagggattttccaacaacttcggattcagcggcgtggccgtggcccttttgggcggatgtcatccgctgggaatcatcgtctccggcatcctgttcggagcgttaaatgccggcggcgtgaagatgcagcttctggctaaggttccctccgcttccatctacatgatccagggtatgattatcatctttgctgtcagccgcgagctgtttatctggtttggcaggaccggaaaatctttgattccgggcaaatctcataacgccacaggaggtacgagcaatggttgatctgattacaaactttctcaccgcggatatccgtaccgcgacccctctgctgctggccgcgctgggactggtattcagtgaacgcgcgggcattgtaaacatcggaactgagggaattatgctgatcggcgctctgttgggctgcgtcggcgcgtcctttagcggctcgtccctggtcggcgcgctgacggccatcttcggagggctggtgatgtccctgatcttcgcatttttcaccatcaccctgcgctccaaccagattgtggtcggcaccgccttcaacattttcgccggaggctttaccatcacgctgaaccgcctgctgttaaacggagccaaggtaaaaggctatgtcaatctgccggtcccggggctgtccaggattcccgtggcgggagacgtgctgtttaactggtcccttcccgtttactttgcatttatctgcgttcccctgtgctggtttgtgctgcagcgcaccaacatcggcctgaaggtccgcgccgttggcgaatatccaaaggcctgcgacaccgtgggaatcaacgtgttccgcatccgctacggcgcggtgctgttctccggcatgatggccggactagccggttccttcgtgtccatgggccagttgtcctccttcaccgagggtatggtcagcggcaagggcttcatggccctggcggtctgcgtgttcggaaactattctcccaagacggttctgctggcagccctgctgttcggcgcggccgacgcgttaaagtaccgcctgctgaccaccagcctgggcggatactaccagttcctcaacatgctgccctacctgatcaccatcgtggcactgtgtatgttcgccaagcgcagcaacaaaccggcgtgcagcggcgttgcctacagaaaagaatagggagggagaaggatgtctgaatatatcttagagatgaagcatatcaccaaacggtttgcttccgtggtggcaaatgaagatgtgaacctgagcatcaaaaagggcgaggttcacgcgctgctgggcgaaaacggtgccggcaagtcaactctgatgaactgcctgtacggcatgtacgactcctacgagggcgaaattttcttcgacggcaagccggtgaagatccaggaccccaagcaggccatcgcccttggaatcggcatggtgcaccagcatttcatgctgatccccgccctgaccgtgattgagaacgtgattctgggacttcaggacaacaaggccgtgctggacttaaaggcggcggcccaacgttttacagaacttggaaaacgctacaacatggagatcgacccctgggtgcgggtggagcagctgtctgtgggccagcagcagcgcctggagattttgaaggccctgtaccgggacgccaagctgctgatcctggatgagcccaccgccgtgctgacgccggacgaggtggacggactctttgacatgatgaacatgctgaccggcgagggccacaccgtgatcttcatcagccacaagctcaacgagatcatgaagatctgcgaccgctgcaccgtactgcgcctgggcaggctggccgcaaccgtggagatcagcgaggtgcacaaccgccaggagctggccaatctgatggtgggccaccaggtggagttaaagaccgacaaaaagcccctgaacctgcggggcgaacgcctgaaggtggagaacctgtgctgcgacaacgaccgggggcttcccatgttaaaggacgtgagcttctccgtccagggcggcgaaatcctgggcgtgtgcggcgtggacggcaacggccagtccgagctggttcagtgtatcaccggcctgcgccaggccagcagcggcaagatcaccatcaccggagtggacaccacccacttcacccccaagcagattctgaacctggacgtgtcccatatcccggaggaccgccacaagtacggcatggtcggttccatgtccgtggaggagaatctgatcctggtcagctacgaccggaagctgttctccctgcacaatttcctcaactggaaatggatcgcagggcacagcaaaaacatctgcgacctgtttaaggttaagacgcccaccatcaaggagaaggccatcaacctctccggcggcaaccagcagaaattcgtggtgggacgtgagctggaccgcacgcccaacctgctggtggcggtccacccgtccaggggattggacatcggagcgaccaagtacattcagtcccagatcatgggtcagagggaccggggcaccgcggtgctgatggtgtccacggagctggatgagctgatcgagctgtccgaccgcatcatggtcatgttcgagggcaaaatcatgggcatcatcgaccagaaggacgcttccagggagacactgggaccgctgatggccggtctgaccgaataaaacgcatcaatcaatccccgtcggggtcattgctttcacggcaatgactccggcggggatttttgatgtggaatacgctttagtttcggttcatctgcacacggtactgcttgggcgagattccgttttcccgcttgaacagcttgataaagtagtttaagtcgctgtacccgcagctggccgccaccacctggatggggatggtggtggagttgagcagaaccagagcgtggcgcagcctcacggcgtggatgtagtccgtcagcgtgctgccggtctccttgcggaacaggttggagaggtaggacttggtcacgtgacacatatccgcgaaaaaggagagcgtcaggggctcggcgtagtggaagtccgtgtaggtgatgcagcgctggatcaggcgggagtagtttttcatggagtggttgcgcaccagcagacagtatttgtggatcatctcgttgtcgatggcgtccagatcgcccatggaccgggactggttgatgcggatggcgaactgggtggagagttcgtcaatgtagtaggggtgcacatggcccttctggacggccttgcggcagagggtgttgaggataatcagcatgtttttccggttgatcagggcgttttccgtcctgggggtgatccggtaggttttgaacaggctgtgataccgggacgccttcatgtggtccccgcaggcgactgcctccagcatctggtcctccacctcgtagcgctcctcgatggtgttgatggcgatggagggggcgtcgtttaacgcctgggactgggagggggactccagggtcaggtccccggcctccgggtaggagcgcagcacgtgggcttccccaaacaggtgatccgcgatggtgaccagggtggactccagggatttgagctccgggggcacagcgatgctgctgtagaatacctgaagttccttaaacaggctgtccggcagctttttgcggaacatgattttctggatctcacccgggccgggggcggcctccagcaccgggcctgcgatgacgcacagggcctgtcccatctgggccagggagtctgcgggcagcgggaaaatgtacaggatcaggccgaagtcgtccttcagcttcaaaagctcgccgcggcggcagtgctttaagatggcgtcccgcagctttgtgtagtcgtagttggagtaaagcttgctgcgcagctccatgtccgccttgtacaagttggaaaaatcccggtccaccagaaggcagttgatgttgtgagcctggacgatctgggaaaacagtgtgagatggtcaagttccatggaaaacctccattttaacaaaaaattaatcgtataattttacacataaatataaaaatattgaactgaattacagtataccaaaaaatcgtacgattttaaagcaagattaccccttttttatgatctgattttacggtaaagtcaatccatcaagaggcggtaaaaggaggaagcgatggaacggatggaaatgaacccgttttcgggttttgagcggaagaaggattatctggtctgcatcgactcggacggctgcgccatggacaccatggacatcaagcaccaccggtgctttggcccctgtatggtggaggaatgggagctggataactggcgggacccggttttgttccgctggaaccaggtgaatctctactccatgaccaggggaatcaaccggtttaaagcgctggccctggtgctgaccggggtggaccgggaatacaggaaaatcgaggggctggaagccctgaaccggtgggtggaggagtcggacgagctgagcaacggcgctctggagaaagcggttctgagggaggatgatctctgtctgaaaaaggcccttcgctggtctcaggcggtgaaccgggaaatcgaacagctgccggaggagagcaagcgcgcatttgccggcgtgaaagagggaattccgctgatccaccagtacgcggacatcgcggtggtatcctccgccaaccaggatgcggttgtgaaggagtggggcgcgaacggcctgctgcgggatgtggatattgtgctggcccagaacgccggctccaaggccggctgcatccgggaactgctgagatacggctacccggcggaccacgtgatgatggtgggcgacgcgccaggagaccgcggggcggcagaggcaaacggagtctggttctacccgatcctggtgacccgggagtacgagagctggcgggagctgccgggaattgtgaagcggctggccggaaatgcgttcggccgggatgaccagaaacggctgttggaagaatttgtaaataatttgcagggataaaccggaggaggaaaaaacatggtagatttaagacagaaaccctactatttaaatgaggaacaggtcaaatgggtggaggacaccatcgcttccatgacggtggaggagaagatcggccagctgtttgtcaatatggtggcaaacgccgacgagcgcaggccggaagccatcaaagcggtgttaagtacataccatcccggcgcaatccgctaccacaacgcccccaaggaggagctgtgggagatggcgaaaaacttgcaggagtattccaaaatccccctgctgatcgcctccaactgtgagatgggcggaaacggcggcgtcaacgagggtacgactttagccaacggcgctgccatggctgccatggacagcgaggcggaagtgcgccggatggctgccatcagcgcaaaagagagcgaggccgttggctgcaactggaacttcgctccggtggtggatttgacctacaactggcgcaacaccatcgtgcagctgcgggcctttaacgacagcccggaggacgtgatccgttacggcaaagcgttctttgagggcatgagaacgaaaaactttgcaacctgcatgaagcatttccccggggacggcaccgaggagaacgaccagcacctgatcatgggcatcaacggcatgagcgcggaggagtgggacgagagcttcggcaaggtgtacaaggctttgattgacgagggctgcatgaccatcatggcgggccacatcgcccttccggcctactccaaaaagctctgccctgggataagggacgaggaaatccgccccgccaccctggcccccgagctgatcaccggactgttaaagggccagctgggcttcaacggcctggtggtgacggacgcctcccatatgatcggcatgttcggcgcgaccattccgcgcagcgagcaggttcccggcgccatcgcggcgggctgcgacatgtttctgttcttcaacgaccgggacgaggatttcggatacatgatggacggctaccaaaagggtgtgattaccgaggagcgcttaaacgacgccctgcaccggattctgggcgtgaaggcggccctgaacctgcacgtcttaaaggcggagggaaatctggtgccgcccagggaaaatctggccgtggtgggctgcgccaagcaccacgaggcggccagggagatggcggaccgttttgtcaccctggtcaaggaccgctgccattatctgcccttgacaaaggagcggtacggccggctgaagctggtgtacatcggctccgaggctacggtgatcgcgggacagaagttcaagagcaacgacgacgcggtgattcaggacattgtggagcagctggaggcccggggcttttcggtggacgccgcggtggagcagaagaaggggaaaatggaggagttccggcgaaaatacgacgccgttctgctggtgttaaacgtccagggcttcgcccagttcaacaccatgcggatcaaatgggatgagccggccaaacagccctggtatatgtcggagctgcccaccttcgtggtgtccttaagcaacaccaacaacctgatcgacgtgcccatggcgcgctgttatatcaattcctatctgccgacccacgaaacatttgccgccacgctggaaaagatggcgggcgagagtccgtttatgggccggtacaatgaaaatgtgttctgcgggagatgggaaaccagattttaaattagggagaaaaaacagatggaccaaaaacaggtaaagccctttgggctcagtgataagattggatatttatttggggattttggtaatgatttcacgtttatatttgccagcacctttttgatggtcttttatatgaaggtgctggggattccgggggcggcggtgggaacgctgttcctcgtggcccgggtggtggatgcctttacggacgtcaccatgggccggattgtggacatctgcaagccgggaaaggacgggcgctttaaacagtggatccgccggatggcaggcccggtggccatcgccagctttctgatgtaccagtcgtccctggccggggcttccatgacggtaaaggtggtctacatgtacgccacctacctgctctggggcagcatctgctatacgggaatcaacatcccctacggctccatggcttccgccatcacggagaagccggaggagcgcacggctctgtccaccttccggggcgtgggagccaacctggcccagctggtgatcggcgtcctggggccggtgatcatttacaccacggatgtggacggggcccaggtgatccggggcggcggcagtatctttccggtggtcgcgggaattttctccctgtgcgccatcatctgctatgtgatctgctacaagtgcaccactgagcgggtgagaattgagaaggacccgaacgcccccaaggtcacgctgcttcagacatttgcgacgattttctccagcagggcgatgctgggaatcatcggggcggccctgttccttatgctgagccagctgttgatcagcggcttaaatatgtacctctacgccgactatttcggggatgtgaaggcattttccagctacacgttcatcaacatcatgctgtccctggtgctggccggatttgtgggccggatcaccggacgaatgggcaaaaaggaagctgcggcggtggctacggccttcacgggagctgtgtacctggtactgttcgcactgaagcttacaaacccctggatttatatgatttccagcgccattggatttttgggcgtgaacttctttaacctggtgatctgggccaatatcacggatgtgatcgacgacgccgaggtgaagaacggaaagcgggaggacggcacgatctacgcggtgtactcctttgcgcgcaaggtggggcaggccctggccgggggcttaagcggctatgccatggggctgatcgggtatcagtcggcggcgaaggtgcagacggccgaggttttgaaagggctgtacaccatctccacactggttccggcgctgttatttttctgtgtgacctttatgctggtggtagtatacccgctgaacaagaagaaggttgaggagaattctgagatactgcaaaagagaagagcggcaagatagcccaaaggggcgcggaccggcggtttcatcccgctgtccgcgcccccttttcccgcttggcggcggccgcgcagccggcgggagcaggaatttcaaaaaatgggcataaaaaatcctcccggtgggttggtccggaaggagaaaggttgtctctatctattaagcgatggaattaacagccttggataaacggctcactttgcgggaagcagtgttcttgtggtaaactccctttgtggtagccttgtcgatctcagaagtagcagccagcagagcagcctgggcagcagccttgtccccagcagcaacagcagcttcaaccttcttaaccatagttttaaccttagaccggatcgctttgtttctagcagctttcgtctcgtttactaaaattctcttcttagcagatttaatgttagccaatgaaatacacctccgtttcttcatgaataattatctttgtgttttccatcaaagcctggacacggacagttcaatgtaaacatacctttgtattttagccaattcagaaggaaaagtcaatatctaaatacatattttagggaggtttttggaaaaatattcgtaagagtgcaggcggcgggaaaattggccgtctgaacgattgcaaatgttccttaataaaatgtgagaaaggcggatacggtaaatggaagagatggaaaaaggcagaaccgggcaatttgaggtgcgcacagacctggcactggaggagcgggagagctttgagggcgacggcggggaggtttccggcgtgtcgctccgggagtgggaccgcaaacggactggggtcaagctgacggaggtccggattttaaatgaacagggcgcaaaggccatgggaaaacccatgggcacctacctgaccctggaggcggaccggctgtccaaaaaggacgacgagtatcacagcgagatttccgacgagctgggagcgcagctgaaaaagctgatggaccagatgctaaaaggtcaggagcgggaaacgctctcggttctggtggtcggtctgggaaatccctcggttacgccggattccctggggccccgggtgctgaacaatctccaggtgaccaggcatctgaccggggagtacggggcggatttcctgaaaaagcgggacctgcccgccatcagcggcatcatcccgggggtgatggcccagaccgggatggagaccgctgagattttaaaagggatcatccaccagacccggcctcagctgctgatcgtcatcgacgccctggcggccagaagcgtgcgcaggcttgggaccaccattcagctgacggacacggggatccaccccggctccggggtgggaaaccaccggcacagtctgacaaaggacagtctgggaattccggtgctggccatcggcgtgcccacggtggtgggggccgcggccattgtccacgacacggtgtccgccctgatcaacgccctgtcccagagcgagagcaccaaggccaccggcaaatgggtgggggatatggactccgaagagcagtacgagctgatccgggagctgctggaaccggagttcggaccgctgtacgtgaccccaccggatattgacgagacggtgaagcagctgagctttaccatctccgaggggattcacagggcggtgttttagagggggtgtgaaatccccagggcgcagccggtacatctgtgattccctgtcttttatcatttctcatcaactgcagctgtgtagactgaaaaagcgggttgagattccgggcatccggattctcaacccgcacggtacttaccgggaggggcagcctccgcaggccgcgcagccgcctgtcaggccgtccgccgcggtgccgaatacctgctcgtggagcctgcgcccggtgggggtggcggccaggccgccctcggccgtctccttgagagcggtgggcatggtgtcgcccacctttttcatggcccaaatgacctcgtcggcggggatggcgctctcgatcccggacagggccagctcggcggccacgaaggccccggccacgccagaggcgttgcgcttgatgcaggggatttccaccagcccggccaccgggtcgcataccaggcccagaatatttttcagggcgatggcaacggcgtgtgagatcatggccggagtgccgcccgcaagctcggtgatggctgcagccgccatggcggccgcggagccgcactcggcctgacaaccgccctgggctccggccaggctggcgttattggcgatgacgatgcctaccgcggaggcggtgaacagggccatgacgcagtcgcgctccgggatttcccgttcctcctgcatggtcagcagggcggcgggcaggataccacagcttccggcggtgggcgcggccacgatacggcccatggaggcgttcagctcggagactgccagggcccggtacagcgcgccggagagcagggagccggtcaggctcttgccggacttcgagacctggctcatcttgtaagcgctgcctccggtgaggccgctggtgctgcgcaggtccggggcgcagccgggttcaatgcaggaggccatgacccggtacgtctcctccatatgccggtagatttcatcttcgctctgttccatctgctccgcctgctgcatcagcaccagacgggagaccggcaggccggatttctcggccgccgcgatcagagaggcgagggaattgtaattgaattcgatttccatgggaaaattcctttccgtagttgtaagattgtctgccgcccgggccggggcttccggccgcgcgcgggaaaaacgccctgtcagatgggctgtagcatggtgctggagaaaatattcggcagaacctgcaccttgtcgttgagctcctgtccgaagctgccgtcgatctcgatggtcataacagcctgtccgcccttctgttcccgggacaggcggaagttgcagatattgactccggcatcggccagaacctcggtgacggaggcgatggtgccgggggcgtcacggtggagcacgatgagcgtggtgtgctggccggtgatggacacgtccatgccgttgatctcgcgcaccaggatgttgccgccgccgatgctgctgcccaaaaggatgaccgtgcgtccgtctgcgtcggtgaggatcacccgggcggtgttggggtgggcgccgtcaatgtcgccggtggtgatgttcacctcaaggccctgctcgcgggccagctccggggccaggcggatgcgcgggtcgtcggtctccatgcccatgatgcctgcgatcagcgccttgtcggtgccgtggcccttgtaggtcttggcgaaggagccgtggagcaggatgtccgctttcaccggttcggtgccgaggagcgttctggcgatgcgcccgatccgcgccgcgccggcggtgtgggagctggaggggccgatcatcacgggcccgaggatgtcgaatacattcatatgtttatctgcctttctgtttattttcgccagggacaatgggccgtgaccattcgcctgtattgggcggcagccagcggagaaaatgaccgtggcgggcattggcctgtgcgaaacgtatgggctgtccgcctgctgcgggcaggaggaggccgttcgccggtttttatgggcgactttttttaaaacgcctgatccgttttaaatgaaccggcatcctctattatagcctaaaaaccttcaccggaaaaggatgtaaaaggaaaaaacggctaaaaatggcataaaaaacggcggttggttcctgagatggtgtttttgccaggcggccgcggcgtcaatggcagatggctggattttctgccagggatctcctagtgtaattgccatattttttatgttatcctatgtttgtaacagaaatgtaaaatttatgtaacaatacaggaggcaaaacatgagaaaattaccattatatgcaatgacggccctggcggccatgacgatgaccggaaccatggcgatgacgtcccaggcggcggtgctgacttacgtggttggaggaagcagttctaccggctgtgattatgggaacggacaggtgattggttggggaaatatgaggccggatgggaatgggccgcagattgtgttcccggattttaatgttccgaatatgccggtgttcccggatatggagatgcctgcgctgccggacggcgggaattcccagctgccggatatcggagtgccgtcccagccggagcagaacggcagcatgagcgcttacgcggctcaggtggtggagctggtgaacgcagagcgcgcaaaggcggggctttcgccgttgaaggccaacagccggatgacgggggctgctgaggtgagagcgaaggagattgagcggtctttttctcatacgagaccggatgggagcgggtttaatacggtgttgacacagaatggggtgagtttccgcggggcgggggagaatattgcgtatggacagcctacgccggaggcggtgatggagagctggatgaatagtgcggggcatcgggcgaatattttgaatggggagtttacggatattggagtggggtattatgagaatggaagtggagtggggtattgggtgcaggtgtttacatattaggttagagggggaatggaagagaggtgtgcttgggcatgcctctttttctttggggtttttagaggcatccgggcgtgagcggcaggggagcgggggcggaggttccgggactccgcggtggcagcgtctaagacggaatcggcgcgaaaaggcgggcaccgctccgagctacggcgccggccttaagccggcccctccgcctacgctttgctccgggctttgagagccctgcgcaatcccgccttttcacaccgattccgcctaagacgctgcgaaccgctacatagtcacctccgcccccgctcccctgccgctcacgcgctgggggtcgagaagggcgagggggatggggagcgaggggctatgtagttattttggcatccaagttcctgccggtcattcgctggatgggtgagggcaaaaaaggagcctcaagtctggtggtgggggatggacttgaggctccttttttggctctagggggtgggggagaagagggatagggcggtttttagttcggggtggtgggcggcggcggtggttaggggtgtgtgggttagggcggcggcgacggcttgggacatggcgcggacgccggcggcggggccttggggatggccttggatggcgcctccggcggccaggatgatgtcggtgccgaagtcgtcgataaagcgctggaccatgccggggtggactccgccgccgcagatgggcatggtgggctttaggtggcagcagggcaggcttaactggtgggcggttttgaagtattgctgccgggtcaggggatagccgccgtagggggtgttcatcatgaccaggtcggctccggccatgcgggggaattttccgatggataggtgggagctgagaccgctgtttaaaccctcgttgctgattccgctggccgcgtagtggcccatgaccgggatggggatctgctcggagatggcgcggaaggtactgtagcctacggtggaaaagcacagcatcacggctttggctccggcttccaggacggcgcttagggtgtccttgaggcgggcggaggagtcggtgatgttgcagatgtagatggtctccttgccggttttttcgtaggcggctttggcggcctcgttgtaggctttgacccgcttggctgcgggacagaagtccgggttagccagcagctcgtcgtccttgatgaagtctacgccgcccagggcggtttcgtagaagattttggccccggcttcgggggtcaggccggtgcagggtttgatcatgttgagcagcagcgggcggtcccagacgccggtcagctcccgcaggccctggatgccgaatttggggcctttaaaatggctgagaaaattttccgggagctggaggtccaccagctttacctgggcgctggtggaggcgtcgttacccagaagggtggtgaacatcatgggaaactgggggccgaagtttacggtggggtaggcgatttggatgaagtaggtgcgcaggccgtcgccaatctgggtgctcagctcgcagggcggggcatccagaatgttcaccacacggcccatgtgcgtttcacgcatctcgtcggtgacgccgggaaccggcacccatgtgcccacggtctgccctacggccatggtttccgcttttttcaccacatccaccgacggatccagctggatatagtaggtggccagggcgtaatcctggtcccggacgtgttccgggagaacgaacagggatggacggctcatcggattacctccttttgggatttgcagctgtcggacaggggggaggcagcgtttttacggctgccgaatagcggcaggacagtgcgtatgatcgcgttaaaacggtctgcgtcccaggcgcttctgccgataaacaggccgtctatgtggggcatctgaattaaaaggggagcgttttccgggttcacgctgccgccgtagagcaccgggatgtccgggccggtttcggggccaaaaagctccaacagggtgtccttgatcacgcggtggcgctcgtcggcgtaatgctcgtcggccgggacgccgtttacgccgatggcccaaacgggctcgtaggcgatccagaggttggcggcctgctcccgggtgatggagtgaaggccgatcttcagctgggcgcgcagggtttcgtcgctgaggccgtaggccttgtcctgggcggtctcgccgatgcataacagggcggtgaagccggaggccagggccttggctacttttttctcctcctcccggtctgtctcgccgaatacatggcggcgttccgagtggccgatcatggccaggtttacaccgatctcctgcagcatgacgggggaaatctccccggtgaattggccttcatcctcccagcccatgttctgggctccgacccggatccgtccccccgccgcggtccgcgaggcggattccagggcggtgtaggacgggatgacaaacagctccaaacagtccgccgggatatccgccgtcagctggtccaggcgggagagaaaggcggtggtgtccgagatggtcttatacatttttgtgttggttcccatgtaaagccggtctaaacgtttcatatgtaccctccatccgatgccggtcagctcccggccttcatattgtgatgttccagctcgttaatcgccgccaccttgggggtggaggagccgtccttgaactccagggtcagccattcgcccagaattttctttgccagctccactccgatcacgcgttcgccgaagcagatcacattgccgttgttgctgagctttaagcgctctccggaaaaactgtcgtggcagacgcccgcgcggatgccggggaacttgttggcggtcatggccatgcccagcccggtgccgcagatcaggactccttccttagtataattgctgtcaatgatggcctggcaggccttagcggccacataggggtagtagatcgggtcgtccgggctgtcgcagcccatatcctccaccgtgtaccccgctgcttccatgtacgctttaagctgattcttcatgctgacggccgcgttgtcacagccgatgactatggttttgttcatctgcaaatcctccttgcgatacggtgttgttaaacccatattagcacaggaaaaccctacaatcaagacgaaaacaaaataaaatattgtattttttgagttttaaatcaaaaatacggtataaatcatgtaaaaaatgtgggattacgccttaaaacaaatataaatcaagaaaaacaaaattattaaggcgtaaagtaaaaacaaacaaaaataaataaacaaaattatgataaaaagtattgttaaaacgaaaagaatatgatacaatatacccagaaattttcgagaaagttttttgtattttcatgaattcactaaaacaatattaaggagaatttgaaaaaatgctgagaaaagagctgatcagactggatgtggaagcaaaaacagctgaagaggcgctgcggatcatggccggactgtttgtggagtccggggttgccaaacccagctatccggatgccattgtggcccgggaggcccagtaccccaccgcgctgccggccaccgcgtttgacattgcggtgccccacacatttgcggagcatgtaaacgagcccgccatgggcatctgcgtgctgagagaaccggtggagtttcatcagatgggctcgccggagatcacccttcacccgcgcctgctgttcatgctggcgatcaccgatcccaaggaccagatcaagctgctgcgcaagatcatgaagctgatccagaacccggaggcgttaaatcagatccgggaggccaaggatgtggacgaagtttattctattgtgaacccgcagctgttttaacccgcggagcgcagtagaacaactataatatttaactcagaaaggaaggttttatctatgggaaagaaaagtatcaaattattaaccgtgtgcggctcgggcattgtgacatcttcgatgattgccaacaagctcaccgagatgttcgaggacgagggctatgaggtttccgcgatggaggccaatcccagcgagatgggaacttatcttgcgcgggacaaatatgatctggtcgcctacgccagccccatcgacgaggatgagttaaacggcacgccggctctgcccgcaatcggtctgatcaccggattgggagaggatgaatttttggaaaaagcactggagatcttcaaagcagctggaaagtaactgtggaaagataagggggataaaccatggatatgttttttggagcagtaaaggcattctttgacacatttagcgcagtcgtattcgttcctatgattatgttcgtcatcaaccttgcgtttaaggtaaagcccaaaaaggcttttatctccgcattgtccgccggcgtcggcctgcagggctttaacctggtaatcggagcctacggtcccatcatcgagccgatcatcacccgcatggttgagaccagcggcgtgaacctgccggtatacgacgcgggctggcccaacacctcggttgtggcttactccacacaggccggcatggtgttcgtggtcatcgcaatcctgcttcaggtaggtctgttcctgtccagatacaccaccgttttccaggctggcgatctgtggaacaactattcctacttctgctggggttccatgctgtacgttctgaccggcaatatgttccttgctatctgcctgatgaccatgcagctgttaatcaccctgctgatcaccgaggtgatcgccaagagatggtctacctactacggctatcccggctgttccatcgcttccttacatacggccacggtggcggtgatcgccatcccgttaaactggctgctcaataaactgggcctgtacaagatccagatggatcccaacggcatgcgtaaaaaactgggcatcatcggcgagcccatgaccctgggcctgatccttggtatcctgatcggctttgtgggcaacatcaccagaatcacccagctggctgcctggggcgaaatcctcagctgcggcgttgcgacttccgctgttatgtccgtattcccgaagatctcttccattttctccggcgcatttacggctctgacagaggcttccaagaaaaagaccaaaggcttcaagggcgagtggtacctggcagtgaacgacgctaccggttacggcgagactgcaaccctggtttccggactgctgaccatgcccatcatcctgctgcttgcgttcgttctgcccggcaacacaacgctgccgatggtagacctggttgcgattccttacgtgatccagcccatcgtggcaatgtccaacggcaacgtggtgaaatccgtcatcggctccaccattgtatgtatcatcttcctgtatatctgctccgcctgcggcagcacatttacggaggttgtgaaggtggccggcggctccctgggttccggcggcgcaatgatggttacgtcctttatcatcatcggacagcccatcggatacctgaccttcctgatattcgccagccaaaacccgatcctaatcgcgcttcttgtggcggtctacgcggtttcctacgtgctgatccgcaagaacaaagagaagatctacgcggctctggagaatcaggctctgaatcccggagggattgcatctgctgcacaatagggataacagcataattcgatgaatgactgaaaatgctgcactgtttaaacggcagtgcagcatttttgaccacggacttttcccgtggagaacagactggctttgaggaggagacaaacatggttacacatcagggaaatccggtgtccaaaggcgcggcggtgggcagggtttacaagtacgttccctaccaggccgtggtggaacagaccggcatccgcccggaacaggtggaggaggagttagccgcctaccgggccgccagggagcgggccggggccgagctttccgccatgcgggagcggctgggagagggcgacgcggacaaggcggcgatccttggggctcacgcggagattctggccgatccggcgctggatgagatggtgtccgggctgatccgggacgaatattacaatgcaaaatgggcggttgaccgtgcattttccaagtttatcaagatgttgagccgggtgaaggacgacatgatccgggagcggatcgcggatatgaaggatgtgcggcttcgccttctgcgcagctgcgacggagccggggaggtaaacctgggcgcgctcacggagccggtggtcgtggtggcccaggatttgttcccgtcggacaccgcttccctgaaacgtgagatggttctggctattgtgacggaggttggaggagccacctcccacaccgcgatcattgccagaagctatgagattccggcccttttgggcgtgagcggcgccatggaccttctgacggacggacaggtggtgggcgttgacgccatcgacggagtcctggccacggatttgtccccggaggagaccgcggctctggagaagaagggcgaagcctgccggattcacgccctggagacgaggaaataccagggcgcagagccggttaccggagacggagtccgcatcgatgtggagctcaacatcggctccgcctccccggaggagctggaggccgcctgtttcaccgacggcgtgggtttgttccgctctgaattcctctacatgggccgggataccctgcccggggaggacgagcaggtggagatttacaccagggtgctgaaggcctttgaagggcggccggtgaccctgcggaccctggatatcggcggggataagaagttggactgcctggagctgccgaaggaagagaaccccttcctgggaaaccgggcgctgcgcctgtgcttcacctacccggagatttttaagacccagctgagggccgcgctgcgggccgccgtggcgggggatctgtggatcatgtttccaatggtgggcagcatggacgatatccgcagggcaaaagccgcgctgcgggaggcggaggaggagctgaaggccgagggcaagcccttcgggccggtcaaaaccggcatcatgatcgagattccctccatcgcgctgatcgcggacatggcggtccgggaagtggactttgccagcatcggcaccaacgatctctgccagtacgccaccgcggtggaccgtatgaacccggtggtcagcgcgtattaccagaaataccacccggccatgttccgcctgatccgcacggtggtggagacttttaaccgggcggggaaacccatctgcgtgtgcggggagctgggcggcgacgagctggccgcggccgtgctggtgggcctgggcatgagaaaactgagcatgggacgggccttcgtggcccagaccaagaaaatgatcaccggcatgaccatttcccgtgcccgggagatcgcctgcaaggtatgcgacatggagactgcggctgagattcaggagtacctgacaagcgagctgcgggatattttataaatcgagaggaaagaggtaaatacagttatggtaaaaggaaccacggtaattaagaataagacagggcttcacgcccgcccggcttctgattttgtgcaggcggccggcaaattcagctccagcatcacgatccgcagagtggacgaggaggacgatgaggccaacgccaagagcattattttcttactgtccctgggattgtgccagggggaagcggtggaaatcacggccaagggagacgacgagcaggaggcggttaaaacgctgatcgagctgatcgattccgggttcggcgagtgagaaaccagtgaaaaatcagagaggttgattgcatatgagaatggtgtttaactttaagatgtccctggaggactaccaccagatgatggtgagccggacatttggaaattcctggataaggcggatcatcctgctggtggtgtggctggtatttaccggcctgatcgtcctggatctgaccggtgtgatcgagctgacccggatcgtccatgtgtgcgccctgctggtggccgtgtccttcccggccgctgttatcaccatggagatcaacgtttcaaagtacaaggatgcgtatctgtccggcttcaaggccgagcgccagatcgtggcggacgaggaagggctgaccttctgcaaccggtccaccggcgagtcgggcagcaacccgtggggcgaggtgactaagctggaggagctaaaggacgtgtttgtgatccagttaaaccggagagaggctgtcattctgcccaaacgcggcatgggaaacacaaaaaaagtggatcagtttagggaaatggtcaaggaaaagattccggagcgtttttatcccctgaagcgctctgtattccggtaaagcgggacagacgaaagagccggaatcccatacccggggttccggctctttcgcggtcaaatcttcgttttggagcagcgttttttgggtccgtctactcgttctgcgcctcatataccgccacattgtggctgttcagaaaatccacccactggctgctcagcttccggtccgtcaccaggccggtgatggcgtcgaagtccgcgatgtggatgaaactggtcttgtcaaatttcgaaaaatcggccaccagatacacttccttgctccgctgggccagagactggcggacggcggccacggattccagggaatcggtgattccgtgctccatggacaggctgcggcaggacatgaaggtcttgtccagatagaaggtttccagacaggcctgggtgctgaggccgttgaaggccttgtccctgggggtgtagttgccgccgatggcgatgaggtggatattggctttgtcacacagctcgttgatgatcatcagggagttggtcaccacagtcaggcgcatgtcgtttatggccttggcgatggtcagggtggtggtggaagaatcgagaaagatggagtcgccgttgtggatcagctcccggcagcgggaggcgatggcctgtttgttcttcagataggcggtttcgcggatggataagtcaatgttgttctcgacgccgtcctgtatgaaggcgccgccgtaagtgcgggtcagaaatccctcgctctccagctgttttaagtccctgcggatcgtctcctcggtgacggagaaaatcttggccagttcggtgacggttacgctctttttttccagtacaatatctttaatttcggatttacgggttacggcaagcatatagcctcctttttatggagatatccataaagattttcttttattatagcataaagaaaagaaaactcaaatagaaaatgcgtttgcaagctgttgtttgctggcaaatacaaaagaaatatattaaaaaattggcaaaaaccaaaagaaacaaaaacaatcaaaaacaaaatgttgacgaaacaatacaaacacaatataatatggttatcagcccgtgcggactcagatccgcggcgcgggattgaaaacgttttgtgttggttgaggagataactttttagagagcagaggtgagtgaaaacatgatgacgattcagggcatgaaatacaagtcggacttcgaggcgaagaaggcgatcctggatatcgggcggcgaatgtacgccaagggctttgtcgcatccaacgacggcaatatcagctgccgggtggggcccaacaccatctggaccacgcccacaggggtttccaagggttttatgacccaggacatgctggtgaaaatggatctggacggtaaggtgctgatggggcggttaaagccgtcctcggagatcaagatgcacctgcgggtctaccaggagaaccccaggctgcaggcggtaacccatgcacatccgcccatggctacgtgttttgccatcgcgggccagcccttggacgcggcgatcctgaccgaggccattctgagcctgggcaccattccggtggcccggtacgcgaccccgggaacccaggaggtgccggattccatcgctccctttgtcaatcactataacggggtgctgctggcgaaccacggggctcttacctggggcgacgacatctaccaggcattctaccgcctggagtcggtggagtattacgccaccatccttatgtacaccggaaatatcatcggccagcagaaccatctgtcctgcgagcaggtggaccggctgctggaaatccgcaagaacatgggcatcaccggcggcggcgtcccgccctgcatgaacggcggccagctgaccaaggtttgcgaaagctgcgcggcggccggggagaaatcggctgcggccggaacggagctggcagggggttcctgcggcgtctgcgcggcggccggggggaaaccggctgtgaccggcgcagagcggacggcaggtccctgcggtggctgcatggcggccggggagacacagaccggaccgcaggctccgcttaaaggcgtgacgccgctggttcggccgggagatgccgggaagatgccgggaggcggtttgggcgccggctccggcagcccgtccaccggttccggccccgcggacaaggacgccttgatcgcggaaatcgtaaggcgggttgtggtacagctgaaggcataggggaggttgcagatggagatagagaccagggatattgaacgcattgtgcgccaggtcatggcggccatggagcaggagggaacaatcgccgggggagcgtacccgcccgcgcccggcataacggccccccggggtgataacggagttttcgagcgggtggaggacgccatcgacgccgcctgcgcggcggggcgggagtgggccttccattataaagtggaggaccgcaggcgggtgatcgaggccatccgcgtgatggccagggagaacgcgcgcacgctggcgcagatggtgcgggacgagaccggcatgggccgggtggaggacaaggttgaaaagcatctggcagtggcggacaagacgcccggcgtggaatgcctgaccacggacgccatttccggggatgagggactgatgatcgaggagtacgcgcccttcggggtgatcggggccatcacgccctccaccaaccccacggagacggtgatccacaataccatcagcatgattgcaggcggaaattccgtggtgttcaacgtgcacccgggagcgaaaaagtgctgcgccttctgtctgcagctgctgaacaagaccattgtggaaaacggcggccctgccaatctgatcaccatgcagcgggagcccaccatggacgctgtgaacaagatgacatccagccccaagatccgcctgatggtgggaaccggcggcatgggcatggtgaacgccctgctgcgttccggaaaaaagaccatcggcgcaggggcgggcaatcctccggtaattgtggacgacacggcggatgtgaagctggccgcccgggagctttactggggcgcatcttttgacaacaatttgttctgctttgcggagaaggaagtgtttgtgatggaggcgtccgcggacggactgatccgcgggttggtggagcagggagcctacctgctcacaccggccgagaccgaggccatcgtgaagctggctctgatccagaaggacgggaaatacgaggttaacaagaaatgggtgggcaaggacgcagggctgtttttgcaggccatcggcgtttccggacatgagaacaccagacttctgatctgcgacgtgcccaaatgccatccctacgtgatggtggaacagctgatgccggtgcttcccatcgtgcgctgccgcaccttcgacgagtgcatccaatgcagcgtggaggcggagcagggaaaccgccacacctccagcattttttccaccaacgtttacaatatgacaaaatttggaaaagaaatcgagacgaccatctatgtgaaaaacggggccaccctgagggggcttggcatcggcggggaagggcacaccaccatgaccatcgcgggtcccacgggcgaggggctgacctgtgccagaagctttaccaggcgccgccgctgtatgctggcggagggcggcctgcggatcatctagggaggtgagacggtatggccatcggctttctggagtgcgccgggtacggcgcggtgctgtacgccatggacagggcgtgcaaggcggcggatattgagattatcggcatcgacaccatcaatcccaaggacgcctccgcgttcatcccgctgacggcccaggtaaagttcgcgggcagcgtggacgacgtgaaggtagcctgcgaagtcgcccgcagggccgcgcttaagctgaaccggccggaggacgtgctggtggaagtgatcgagcagccctacgacgggacgaaagcgttgtcgtgtatctcaaaagtgaaatttcaagaagaggcggagtgatcagagaccgctatcgatcaggaggaaaagaattatggcagcaacagcgattggaatgattgaaacaagagggctgaccgcgtccatcgaggcggcggacgccatgctgaaagcggcggacgtggagatggtgggtacggagaagatcggttccggtttggttaccgtgattgtgaccggcgaggtgggcgcggtgaaggcggctaccgaggcgggggaggaagcggcttcccggatcggcgaactggtggcggtccacgtgatcccaaggcctcacgacgacgtccggaaaattctgccggggcttaagtgagagattgcgtgaccggtggacggcggcgctgaggcggatgggccggcgggcggcggagacgaagcagaccggcggatgacggcagaccaatggccggcggcgctggggcggatgggccggcgggcggcctgtacaggcatagacgagcagagataggggcgtgatcaatttgaggcaaagcgccataggtgtattggaggtcagctattttgccaacacggtggtggtggtggatcaggcgcttaaggccgcgcaggtggagctggtgagctgccacaagcggctgggcggcaagatgtgccacacggtgctggcgggctcaacctccggcgtggaggcggcgatggaggccgccagggccgccggcaggatcgtgggggaacacaacgtcaaggtggcggtgaccatcagcaatccccacccccaggtgttgaagcttttgaacatgattgaaaaccatgaggcggaaaaagccgcagccggggaagaacaaacggcggcggatcacaagacaggggaaaatccccgggatttaaagcgagagaggagaacgaaaaatggcagagggaattaaaagaggaatgttggcgctgggaatgatcgagacgagagggctgaccgcgtccatcgaggcggcggatgccatgctgaaggcggcggacgtggagctggtgggcacggagaagatcggttccggcctggtgaccgtgatggtgcagggcgatgtgggcgcagtgaaggccgcagtggaggccgggcaggagtccgcttccagaatcggcgagctggtggcggtacacgtgatccccagaccgcacggatccgtgggcgcaattctgccctttttaaaataggccggggcgcaaaagaacggagcgatttaaatgtgggatagagagaacatggcggcccgtgtcgcagagctggtggccgcccaggtccgggagtttgccgggggatattatcgggtgccggtgggcatatcggcccgccacatccatctgacccgggaggatgtggaggcgctgtttggcccgggacaccggttgacgcccatgaagccgttaagccagccgggccagttcgcctgtgaggagcaggtggagttagttggtcccagaagctccatcgccagggtgcgggtgctgggcccggagcgcccggccagccaggtggagctgtcgggaacggactgtctgaagctggggatcgacgcgcccgtgcgcacctcggggcagctgtctggcacgccgggtattacggttaagggaccggcgggcgttctggaactgagcgcaggtctcataatcgcggaccgccatatccacatgacgccggaggacgcgggatggttcggcgtggaggacggggagcgggtatcggtccgggtgggcggccccagaggcggcctcatgggccaggtggtgatccgggtgtccgaaaagggacggctggattttcacgtggacacggacgacgccaacgcgttccggctcaaacagggccagctgctggagttagtaaaggagggaaccagatgattttgggaacaattcgcggcacggtggtgtcgacccggaaatgccggaatctggtagggtttaagctgctgctggtggaaccctacttcggggataaggcccagctgttcgttgcggccgacaccatcggcgcaggcatcggcgagctggtgctggtaaccacggacgagaccacccagcatgcgctggaccgctcggccccggtggacgcctatgtggtggggattgtggatgccccgccccagctgggcaaataaggttgaaatcatgtctgaagcaggagagaaggaaatgatatgggcagagagagaataaatgcggtgaccaccagctttttcggaaaaggctccatcgggctgctgccgggcgagctgaaaaagcgcggctaccgcagaggactgattgtgacggaccggtttctgtttgagcaccaggcggcggaccgggtgggagagcagatattggcggcgggggcggagtacgccgttttctatctggtccagccaaaccctaccatccaggtggtgaatgactgcatccaggcggccaaggctctggaggtggatttcctggtggcggtgggcggcggttcggccatcgacacggccaaagcggtgagcatcgtcatcgccaacggcggcagggtggaggactacgagggcgtggatctgtccgccaggccggggcttcccattgtggcggtgaacaccacggcgggcaccggctcggaggtgacgtccttctacattgtgaccaacccggccactcactccaagatgtgcatcatggacaccaactgtatggtgagcatcgcaatcaacgacgtggactttatgatgaccatgccgccggggctgacggcctccacgggtatggacgccatgacccacgccgtcgaggccctgttgtccgtgcgggccactccgttgacggacaaggacgccatgtgggcgatccgcgtgatcaaggattatctgcccgccgcagtgaaggacgggcaggacgtgaaggccagagagatgatggcttacgccgagtacacggcgggcatggctttttccaacgcgggcctggggatcgtgcacgccatggcccatgccctgggcggacatttcaacctgccccacgggatctgcaacagcgtgttattgccttacgggatgaagttcaacggcaagtcgcccaacgcttccgggcgcttccaactgatggcggaggcgcttgaactgccgggtgcggcaaaaatggcggacaggcaggcggcggaggcatgtgtgaactatatccgcggcctgtcaaaatctttagggatgcctcagacgctgaaggagcttaagggggtggatccggagaaatttggggatttggcggatttggcggtgaaggatttttgtatgggggataacccggtgagggctgagagggagcaagtgatagaggtttatggggaggcttggaggggagggatttgatgcatccgttcgtgagagtcaggggagcgggggctggggttccggggctccgcggtggcagcgtctaaggcgcaatcgccccgaaaaggcgggcaccgctccgagctccggcgccggccttaagccggcccctccgcctccgctttgctccgggctttgtaagccctgcgcaatcccaccttttcgcgccgattccgcctaagacgctgcgaaccgctccacagtcaccccaccccccgctcccctgactctcaccctctagggatcgaaagcactccctcaacttcctcccctggggtgacggaaatggagccgctgggatttgggctgtatccgtactgcgttccgaccataagttgataaaacattcctttcaaaagttcccggacagggctgctggtaatgaggcagccctgtccaggaactttttactccctattataataagaaataacatgccgccatcacaggtactatcttaagctggcatcaccctctcaaaacgtgggaaatcaagcggagaaaaaagagaatgcgtagtgggtgagaggcgggggaacagggggggaggtgactgtggagcggtttggagagtcttaggtccaagggggcgggaaaggcgggattgcgcagggcttacaaagcccggagcaaagcgtaggcggaggggccggcatcaggccggcgccggagctcggagcggtgcccgtctttcccgtccccttgggccttagactctcctaccgcggagcctggaaccgcccaccctgttcccccgcctctcacgaacggatgcatccctcatcttccttgcaattcccaccctcctcccgcatatgattatagtaatgcggttgaacgcaagaatctgcgggtgaagggacgtgaggcattgtgaggagaagaggtctggcgggaggtatccggtggtttgcggccggtaccgggctgattctggtccttttgctggcaggtcgggctgccgggacggcggcggagaatctggaccgggacgcctgccggcgcgctgtggaaaccggcggccggtggctggtggattatgtgtggcatcaggcccggccggggagcgggggcacgggtgggcgcaccggagacggatgggagaccggcgatccggatccggcctaccggcagtatgaggcggtgaaaacattttacgaggaacaccagtacctggcctggtatggcaacgaggaaacgggggaaactaaggcggagaacggcgaaacacaaaacggcgaaacaacggccggtcagacgggagacagcggaacggaccagagcgcgggcggggcgcaggcgctggcccagggggagacgggcgcgggagccgtgcctgcgggtgcggcgttggtgggggttacctcgcgtgcggtgaccgggcctacctatgtgatggagcagctggcggactacgattttctgatgaagcatttttacagcgttcacacctccaccacggcggggcgggatgagataagcgcggcgcggcttctgggcgaggatctctccatcggagaggacaacagcaaaccccagattctgatctaccacacccactcccaggaggcgtttaaggactccgggccgggggagaccgtggtggggatcggaaattatctgaccgagcttttgacggcaaaggggtacaacgtgatccacgacacctcggtgtacgacctggtggacgggaagctggaccgcagcaaggcttatacatatgcgtacgatgggatcagcaagattctggaggaaaatccgtcggtgcaggtggtgctggacatccaccgggacggcgtgggggagagccttcatctggtgacggatgtggacggaaaaccaaccgcgcagatcatgtttttcaatggcatgagccagacgccggaggggcccatcgagtacctgcaaaacccttaccgggagcagaatctggccttcagctttcagatgcagctggacgcccaggcatattatccgggatttacgcgcaagatttatttgaagggactgcgctacaaccttcacctgcgcccccgctccgcgctggtcgaagtgggagcgcagaccaacacctacgaggaggccagaaacgccatggagccgctgtcagaacttttggatatggtgttgcaaagtagccgaaaaaatgatactattcagtaagcggagggcgcgctgccctccaatccaggcaacagttcagacggcggaaaagttggtttcgagcgctgcgtctgaaccgttccatttttaaaccataagaaagaggataaaacatgtcaatcgttgaccagagcaaaattcgcaacttttgtatcatcgcccatatcgaccacggcaaatccaccctggcggaccggattattgagaaaaccggccttctgaccagccgggagatgcaggaacagattctcgacaatatggacctggagcgggagcgcggcatcaccatcaaatctcaggccgtgcgcaccgtttacaaggccaaggacggctgcgagtatattttcaacctgatcgacactccgggacacgttgactttaactacgaggtgtccagaagcctggcggcctgcgacggcgcgatcctggtagtggacgcctcccagggtatcgaggcccagactctggccaacgtgtacctggccctggaccacgatctggacgtatttcccgtgatcaacaaggtggatctgcccagcgcccagccggaccacgtggcggctgagatcgaggacgtgatcggcctggacgccagcgacgcgcccaggatttccgccaagaccggcgagaacgtggaggcggtgttggatgccatcgtggagaagattccggctcccaacggcgatcccgaggccccgcttcaggcgttgatttttgattccatctacgactcctacaagggtgtgatcattttctgccgcgtcatggagggcacggtgaagaggggcactcccatccgcttgatggccacgggggccgaggaggacgtggtggaggtgggctattttggagccggccagtttatcccctgcgacgagctgtcggcgggaatggtgggttatatcaccgccagcatcaagaacgtccgggatacccaggtgggcgacacggtgaccaaccgggacaacccctgcgcggctcccctgccgggatacaagaaggtgaccagcatggtgtactgcggcctttatcccgcggacggcgcaaaatacaacgaccttcgggacgcgctggagaagctgcagctcaacgacgcctccctgttctacgagccggagacttccgtggctctgggctttggcttccgctgcggctttttggggctgctgcatctggagatcatccaggagcggctggagcgggagtataacctggatctggtgaccaccgcgcccagcgtggtgtaccgggtgcacaagaacaacggggagatgattgagctgaccaaccccaccaacctgcccgatcccacggagatcgactacatggaggagcccatcgtcagcgcggagattatggtgaccacggagtttgtgggatccatcatgaccctgtgccaggagcgccggggcgtttacctgggcatggagtacattgagaccacccgcgccctgctgaagtacgagctgcccttgaacgagatcatttacgactttttcgacgcgcttaagtcccgttccagggggtatgcgtctttcgactatgagctgaagggctatgagcgctcggagcttgtgaagctggacatcctggtgaaccgggaggaggtggacgccctttcctttatcgtccacgcggaatcggcttatgaccggggccgcaggatgtgcgagaagctcaaggacgagattcccagacatctgttcgagattcccatccaggcggccatcggcggcaagatcatcgccagggagacggtgaaggccgtgcgcaaggacgtgcttgccaagtgctacggcggcgacatttcccgtaagcgcaagctgctggagaagcagaaggagggcaagaagcgcatgcgccagatcggcaacgtggagattccgcagaaggcgtttatgagcgttttgaagctggacgacgagtagagacagaactgagaagatgagacatatatgacaaaaaaacagaaaaaaccgttggagctgtacattcacatcccattttgcgcccggaaatgcctgtactgcgattttctttccttccggacgctggcggccgtccacgagacgtatgtggagcagctcatacgcgagatcgaggcggaaggtgcctcctgccaggaataccaggttgtgaccgtattcattggagggggcaccccttctgtcctggagccggagttgatccgggacgtctgcctggccgtgcgccgggcctttgacgtggcccaggacgcggagatcaccatcgaggtgaatcccggaaccctgctgcagaacaagctccacatctaccgggccgcggggatcaaccgggtcagcatcggccttcagtccgctgacaaccgggagttagagaatctgggcagaatccattcctttgaagaatttttaaagagcttccagtgcgccaggatggcgggctttgccaacatcaacgtggacctgatgagcggcatcccgggccagaccctggagtcctggcggaataccttaaaaaaggtgaccatgctgaagccggagcacatttccgcctacagcctgatcattgagccgggcacgcccttctgggaccgctacggcgccggaattgagaaaacggccgcaaaaagcgcgccccagcctgggacctgcccgggggaggcgccggaccggttcggcctgcgccggagggattacccggagctgccggacgaggaggaggagaaccggatctaccacctgacccgcacgtttctggcggagcagggttacgagcggtacgagatttccaactatgccaggccgggctttgcgtgccgccacaacgtcggctactggaccgaggtggagtatctgggcctggggctgggagcttcctcctttctgggcggctgccgcttctgcaacgagcgggacctggagcggtatctgggcctcgattttgccgcggagggctgggcggagcgcctgcgcccgcaatttacccgcctgagccgggaggcgcggatggaggaattcatgtttctggggctgcggatgatccgcggcatctcagagatcgattttgtggcgaccttcggggtcaagctggactcggtgtacggcccggtgattgagcgcctggtgaaaaacggcctgttgaggcgggagggcgtgtggctgtcgctgaccgagtggggaatggacgtgagcaattttgtgctcagcgagttcctgctcacatccgcgtgaggagaattcgaatgacattggaacggacggagattcgccgccggctggaagaactggcggaaccgggataccgggatttcaaccgtaagctgctgcccggcgtggaggatatgctgggcgtcaggacgcccgctctgcgcaggttggcgcgggagatcacaaagggtgactggcgcggttacgtgggccaggtgagaaccgcctggcagcagggcgaagcctgccacgaggagcgcctgctctgggggatggtggtgggcatcggagccggagcgtgggaggaagcggccgcgtacatacgggactttgtgccggtgatcgacaactgggcggtgtgcgacagcttttgcggcacgttaaagatcgccgggaagcataaagaggagatgtggggacttctggccccctatctgggctcggagctggagtacgagtgccggttcggagcggtgatgcttctggactattatatcgacgaggactatgtggaccgggcgctttgcgctctggaccggattcggagccaggcgtactattccaggatggcggtggcctgggccgtgtccattttctatgtgaagatgccggagcgggttatgccctatctgcagaagaaccatctggacgactggacttacaacaaggcgctgcaaaagatctgcgagtcgctgcggatcgatgggcagaccagggcgctgatccggagtatgaagcggtagcgccaccgggcggctgccaggccggacctgccggcggaattgacaaacgagaaatgccttagaggctggagggggtaattaaatgaaactggtggaattaaagtgtccggcctgcaacggcacggtaaaactggacccggagcatccgggcgaggcggtctgcgaatactgcaagacccgctacatcgtggaacaggaatccggagatgagtataaattggggaattttggaagccgtagtgtgggcgaccttccgcctcattcttttcaggaggtaaaacccaggaccgcactgcctcaggagacgcagaaggctcatgaggaggagcggaagcggtttgtgatcatcgccgtcgcggccgccgtggtctttgtggccgctatcgctgtgtccgcccggggttctgccggaaagaagagctcggccagggccaccggcgcggtggtcgagacggcgatagccgcggagccgacacaagctcccgagaagccggtggtgtggtctcagggcatggagcaggtgattttaggtatctatgggcgcacgccggaccaggtcagcgaacaggagctcttgaagctgcgctatctggagctgtcgcccggcctttgggacacgcacaccgaccggaaatatttccgggtgtcctacggtctggacggagatctgggggcggacggcgagatggcgatccacacctttgagggggacctgccggccggtatgaccatgggctgggagctgtttgacgatttctccagcttaagagcgctgaagggtctggaaacgctgtccctgcacagcaccttaaaacccggcgacctggagggcctggacaatttaaggacgctgggcgtgcagtatatttctccgaacgaggtagccgccttggtggacgatccgggccagctgaccgggctgatctacgattataatcagacctccctggagggaatcggacagttcacgggcctggagcggctggagctgcacggaagcgacgatctgaccgacatcaaggacctggcgtcccttaagaatttaaagtccctctccatggaatactgtcccaacctgacggatttctccgtgttcttcaccatgagcggactcacagagctgcgcctggacctggaacatgtgaaggatatcagttttgtgaacagcatgccgcagctggagcgctttgcgctggacgacagccaatgcatctccatcgccccgctttcctcctgcgaaaatttaaaggagctgagcctgaccagcaactacgagctgcccgactacagcgccatcaccggactgacgggcctggagtccctgaacatcgataaatactccaaccagccggacccggatctctcaggtatgaccaacatgaaaacgctgactctggccggattcaacggctgctcgtttttgcgcagcatgggcgggcttacggagctgaccatcgcgggctattgcatcgacgatcccggtgcattttccggtttgacgcagcttgaacgtttaaaggggaccaagagctgggaatacttaaacagcgtggactttttggcgaaccttccggcgctgacccggctggatttgtccggcaccacgttctacacggacatttccgcgctgctcaacaaggaggggctggtgtccctgaacctgaacggcgccagtatggagatcaacttcagccggttaaaggacaatccgggactcctctccctgtccatggacggcgtgaagctgtacaagaacgtgaaggcggaccggtacggcggaatcagcatggtgaactgggacgacgtgacattggacgcggagctgggatttttatcccactatccggggctgacggacctctcactggcggacaacaagctggcccagattcagccggtggccgcgctgcccctgctggagaccctggacatcagcaagaactacgtgacggacttaaatcctctggccgggctggaacacctgaaaaaggtggatggccgggagaacccggtgagcaactggcaggtggtgggagagaaggtcacggtgatccgataattcaaacagagcgcgcaaaaataccgcagccggttttcgccggctgcggcagtattatgggacacttttatggggatggcgtgggcgcgttccggctcagtccgttccggtgacggtgaccaccatcttgttgggcaggcagacgatggtgtccgtgctcaggtgctttttcccctgtttgacgcagagcttgtccgggcaggaagcctcgctgcaccagatttccccgtcctgaaccaccagcacgttggtgccgcctcccgtgccggtgatggtgacggtggcgtccacgctcagatccagggtttccaccaacttgccgtccaccgtgacctgggccacctcggagggaccttttaaggcctgatagcgggtgatgcagtaccagattccggccaccgacaggatcgccagtatcaggattaagtctctgcgcggcagggaccggcccttcgcgttcatggattaccggatggctgcctggtccaggcagtcggataagccgttgacaaagggataggcgttgatgctcacggaggacacggcatccattgcgtagccctcttcgttgatcagaccgcccgtggtctggtggtgaagcacgtaggaggccagggcgtcggcctgatccttccaggtggggccgttttccgtcatgacatagtggccttccacggagagctggcgcttcccgatattttcatcattgacacagtcccaggtacaggcggtgatgcgcccgtcctgcacggtcacggtgacgacgctgtaaaagccgttgtcgtcgggctgctcgtccttgtaggtgtagacgccgtcggccaggggcatgtccggatggttgctcatggaccggtacagggggccggaaacaacgatgaccagtgcggaaagaatggccatgatccccaggcccagatagttctttttgacagcactcatttgtgtcttgctcatacttacactccttatggttaaattagttaggacagttataattttaacacaaatgcaacattcgcacaagaggatggaatgggaattaaaggaggtttgctcgcgatggagcgaaggaaaaatatggctgccagggatgtggcgctctacgggctgctgatcgccctggcctttgttttaagttatgtggagagcctgatccccatctctttcggggtgccgggcgtcaagctgggattggccaatctggcggtgatcgcggccctctacaccgtgggggccggtggggcggcgtttatcagcctggtgcgcatcgtgctcatgggctttaccttcggaacaccgtccatgatcctctacagcctggcgggcgggattttgagcctgctcgtgatggcgtttctgaagcgttttaaggtgttcggaatggtgggtatcagcgtggccggaggcgcggcccacaacatcggccagatcgcggtggcggccgcggtggtggagcaggcggcgctgttcgcctaccttccggtgctgctggccgcggggaccgttgcgggcagcctgatcggccttttgggcgggatggtggtccggcggatcaggcgggccatatccaggtaaagtgcgtagaattttgctagaacacataaaaaattgccattgtgttcaggcccggcggggcatataataaagaaaacgttggaaaagaacactttgaaaagcaggaggggacttttgatgattgatgatgcgatcaggggactggtggagtacggcctggagacggggctgattgaacgggaggacgccatctacgcgcgcaaccagattctggatgtgatgggtcttttagagtaccgggagccggaagcgcccagggcctacgccggcctggaggagatcctgaaggaacttttggacgacgcctgcgccaggggcctgctggagagcgacagcgtggtgtaccgggacctgttcgacaccaggctgatgaactgcctgatgcccagaccctcggaggtgaaccgggaattctggaaacgctacgggcaatcgccggagaccgccacggagtattactacaagctgagccaggactcggactacatacgccgctaccgcatcaaaaaggacatgaagtggacggcggacacccgttacggccggctggacatcacggtgaatctttccaagccggagaaggaccccaaggccatcgccgccgccaagctggccaagcagagcgggtaccccaaatgccagctgtgcatggaaaacgtgggctacgcgggcagaaccaaccacccggcccggaacaaccaccgggtgatccccatcaccgtcaacggcggggagtggggattccagtattccccctatgtatattataacgagcactgcatcgtgttcaacggggagcacattcccatgaagatcgagcgggccacgtttgtgaagctgttcgatttcatcaagctgttcccccactattttctgggctccaacgcggacctgcccattgtgggcggctccattttgagccacgaccatttccagggcggacattacacctttgcaatggccaaggcgcccatcgagaagcattttaccctggaaggctttgaggacgtggaggcgggaatcgtgttctggcccatgtccgtgctgcgcctgcggtgcggggattccgaccggctggtggagctgggggacagggtgctggcggcctggagaggctacagcgacgaggccgcgttcattttcgcggagacggacggggagccgcacaataccatcacccccatcgcccgcaaggtgggggacaagttcgagctggacctggtgctcagaaacaacctcactaccgaagaattcccactgggcgtgtaccatccccaccaggagctgcatcacattaagaaggaaaatatcggcctgatcgaggtcatgggcctggcggtgctgccctccagactgaagaaggagctggcggacctggctgatttcatagcggagggccgggatatccgcgcagatgaggaactggcaaaacacgcggactgggtggaagagttcctgccccgctacgcggccgccggagtgacggttacccgggaaaatgtaaacggcatcctgagaaccgaggtgggaaacgtgttcgccagagtgctggaggacgcgggagtctacaagtgcgatgaaaatggacgggcggcctttggccggttcctggccagcgtgggattcgcggaggcgtagagatccggcctctttggcggaaaaatagaccggcggttgccccccggtctatttttccgtgtggggaagccgtccgcgcaggaaccgctttttcagctcggagaggctgaaggggattagcggatagatgtagctcttcccggcgatggtcttgttgaatacgatggcgcagacggacaggatgactccgacggcgaacccccagatgttgaaaatggccgtgagaatcaggatcagaatccgcatgaatttcatggcgtaacccagctcaaagctggcctgggagtagttggcaatggtcacgaaggccatgtacagcatggtctcgctgttgaaccagccggatttcaccgcatactcgcccagtacgataccggcgatgacgcttaggggcgtggtcagcatgttgggagtgtttaccgctgccagccgcaggccgtcgatggcgaattccaggatcagaagctgccagatcagggggacgtttaacgggtccgacagccggatgaaggccagccaggaggggatcagctccgggttctgcatgagcagcagccagatgggcgtcagcatcagggagagcagggagatgaacatccgggacaggcgcaggtaggtgcctgtgatgggcggaaagtagtaatcgtccgcctcctcgatgatgtcgaacacggaggagggcaggatcatggcggcgggggagttgtccaccaggatgatgatgttgccctccagcaccgaggccgccgcggtgtccgggcgctcggagaacttgaatttgggaaagggattgaaccatttgtgggggtaaagacactcggccaggctctcctggttcatggtcagggcgtccaccttcaggttctgaatcctctttttgatcatttcaagcaagggctggtccacccggttctgcatgtagcagatggcgatgtccgtgtgggagctttcgcccgcggtcatgatctccatggtcagccggggatcgcggatgcgccgccggatcagggcggtgttgaataccagagtttccacaaagccgtcccgggagccgcgcatgaccttgtccttctccggctcgctgacgccccgggcggggtaggtgcgggcgtcgatggcgatacaggtgtcgtacccgtcgatcagcaggcaggagacgccggagagcagctggacgatcatatcgtcgtcctttttgatcaggccgacctcgccgtagggaacataacgcttggtgaacccgtgggcgtcaccgggcatgtcctcctcctttatggtgctgaacacctggaggattttcagcagagtctcatccttcgcaaagccgtctataaagtacaggcaggccgtccgcccgccgatgtgaagggtccggtaaaccacgtcgaagttgttctgcacattcaactttttgtggagataatcgatattatcctgcaggttcgttgagaattccatgaagttcctccttaaaagcgtgtcaaaaataagtctaaaatgagtatgcgcacaccccgggaaattatgcaaaaagacagatgtatttcatgggaggacatgcacagggaaattaatcgaaaaaataaagtcgaaagatgtcgcaattcactaaattgcacaaaaaatattgacaaaatacccccgcgatgctatagtgtgtctgtaagaagcacaatgatgtgccttacaacgttttgtttggtatggggatgccagataaactaaatagtgtgacggtttaagatcgtgaccagaagctgctttctgtgggggaaaggcagcttctctttgtatatggattaaattttctatcaagggttccctgcttaaaactccctattgacatatttcctacaggaatagtatgatattcataacactgagaagaatcacaaaaggacgtgacaaactatgctgatatccaccaaagggcgctatgccctccgcacgatggttgatctggccctccacgcggacggggagcctgtgaaaataaaagacatcgcgaaacgccaggagatttccggcaaatatttagagcagattatatccatactatccagagcgggttatgtccgcagcatccggggaaaccagggcggctactatctggcccgcccggcaaaggactacacggtgggcatgattctgcgtgtcaccgaggggagcctggcgccggtggactgccttacgggggatgacaacccctgcgcgcgccagcaggaatgcgtgacgttaaagctctggaaggagctggacggcgccataagggatgtggtggacggctacaccctggatgatctggtgcagtggcagagagccatgcaggacaattacgtgatctgatccaatccggtccgcccgcagttttcccgaaaaaagacaaacaggagttctgctcatgaatcgaattcgtatgatcagcgactatctcgaacaattaaagcaccggagagaagtccgctacaccatcacactgcttgcggtcattctctccgctttggttcaatcctatgtattgcaggtgtttgcgaggccgtccgggatcatttccgggggctttaccgggttggccatgctggtggagcgcctgggggagctgcgggcctatcatatccccatgcaggtgaccatgctgctgctcaacatcccggtggccgtcctgtgctgtaagggaatcagcctgcgctttaccgccttctcgctggtccaggtggcgctgtgcagcctgtttctacaggtgtttaccttccggcccattttcaacgacgaagtgctgaacgtcattttcggcggcgtgatctggggagcttccattgtgatcgccctgcggggaaacgcttccaccggcggcacggactttatcgcgctctacatttccaaccggacgggcatgtccatctggacctgggtgtttttcggaaacgctgtgatgtactgcatctacgggagcgtgttcgggtggaagtacgcagggtattccattattttccagttcatttccacccgcatgatcggcgcgtttcatcaccggtacgatcaggtgacgcttcagatcaccacggtgaagggcccggaggtgatcgacgcctacattcaccattttcaccacggcatctcctgcgtggaggcctacggcggatacagcaaaaagaagatgtatctgctcaacaccgtgctctcatcctacgaatccacggacgcgattcacctgatccgtcatgtggatgagcatgtgattatcaatgttttaaagacccagcggtttgtggggcggttttaccggaaacccttggagtagatgcggcgggaggcgcgttccctttggagcggcctcctttttgctgcccaaaaagtgtaagctaaatttataaaatattaataattttataatggtcaaagcgttaaaaacgtatatagttaatgatgggaaactaacatcctcaaggggatattggatgttaatcctaaatacacattactggaggctggaatgaaacgaaaaaatgaaagaatcataacgtaccagaagattgaggagtatggacagtggcttgaacgttgtgaaagaagcggagagaccataaagaagtacagacattatttaaaacagtttaaagagttctcaggagacgagccggtgaacaaggagatggtgcttctatggaaagcggacctgcgggagcgcatgactccggtcaccatcaactgcgttatagccgcgctcaacgggtttttcaaatactatggatgggatggctgtgagagcaggtttttaaaaatcagcaaaagctcgttttaccctgagcggagggagctgaccaagaaagaatacgaacggctggtaaaaacggcctttgccaacgggaatgaacggctggccctggtgctggagaccatctgcgcaagcgggatccgcgtatcggagctgtcgtttatcaccgtagcggccatttataagggacaggcggagatcgagtgcaagggcaggatccggaccgttctgctgaccagacagctctgtaggattctgcagtcctatgcgtcaaaaaagaatatcagcgcaggaatgatttttaccacaaaaagcggaaaggcgttggaccggagtaatatatggagggaaatgaaagctcttggcatagaagccaacgttaggtgtgaaaagatatttccccacaacctaagacacctttttgcaaggacctattatgaaatagaaagaaacctgtcgaaattagcggatattttgggacacagggatatcaacacgaccagaatttacacgaaggaaagcggaagtcagcacagattgcagctggaaagaatgaaacttttattgcaggatacaaccgaatatttcttttgttgtactttaggatattcctgaaagatttaaaaacagtatactacattgattgacaaaattctacatatttttgaaaatatttcgataaaaaagggtatattaagtaaactgggttataaattaaaccagaatggcttttttaacagactatttgttatttattttttcttatatctctgattgaattcttctaaaatttcccggaatcagtaacgatcccattttttcagcctttctcccatttttaattacaacaaaagaaatattcggttgtaaaccaggatgggagggataaaaaatcaagaaatccagattcatccgcctttttttggccattttatttgttataaatattcaatttgaagataatttatttgcgatgcagcagccggaagcagccgttgggcaggcggctttgagaggaacgccggccagtcagatgaccagccggaacatggaatttgaaaatctcggggtatccgtgatggacgcgctcaaagaaggggcggaagcaggaggccttataaaaaccggtctcgtttttgggtctgaggaggaggtattttccttcggcagatattattaccggtacatatatctgggtaaagaagaggtgacgctgtattcctcagatgaaaatggggagtatgccgtctatgtttcctgtgagaacccgggtaaggcagtatcggaacaccggcaggtacaggacaggctctccgatgtggcgcaggcctgtctgtcattgagtgacagggaaaaggccgaatatttttataattgggtctatgagaatgtctcatacgaccagacactggagaacagaaccatttatgacgcggtcgtaaacggcagctctgtgtgctggggatatgtatccgcctatctgacgctgtgcaggaacgcgggcctcatatgtgaaccggtatacgccggaaaccatgcgtggaacagaacctggattgacggggagtggagatactgtgatattacctgggataaaagtttaggaagcagctcatggaagtttttaacacagaaagagatggatgcagattctatgcataataatttgtgatgctcagggggaagggtatgacgaataatcttcatggatacaggataacggaattccgtaaatcctgtcaaaggcataacatgatgaggaaatttctcaggccgtttctcttaggctgcggtctcattgtcctggcggttggattcacattgttccacctccatacggcggaggcagagcagacccatacggacctgaggggatcggggactcctgacaatccgtatacggtggaaccgctggacttaaacccgtccgaggaggcggttcagccggaatcccagccggagttcacctatctgggggagttggaggtggctgcctacagctcggatgggaaggaactgacgtactccggcgagctcccggtgaaagggcatacggcggccggcgcgttgtctgttttcaaaataggggacacggtgctgattgatggggatacctatgtgattgaggataaagtggatgaggccgccagtgaaaagctgcggatttattttgacagtcacgatgaggcgatgcaatttggccggaaaacctgcgctgtgtaccggcattccgaagcgcctttagaaggggagaattatctgggggaattccaggtcacgggctattgcagctgctcgctgtgctgcggggagaaggaggagaaactgaccaagtcggaaaccgtgcccaaggcggcccataccattgccgcagacccgtccgtgattccgcttggcacccggattgtgattgacggcgtgtcttacgtggtggaggataccggaaaggcgataaaagggaagcagctggatatttattttgatacccacgaagaggcggtccggtacggcaggaaagagaagtatgtgtatttagaggagtagagttatccctgataaagggttcaatataaatattttaaataaggattggaaggacagtaggatgaaaaaaaggagaatcatgatttttgccggtgcgctggtcattacggctcttgcgccggccaggatccagcccatgaccgcctatgcggttgaagggtggatgagcgatggcgaggagtggaaatatttagacgaaaatgacgatccgctgaaaaatacatggaagcagtccagggattcctggttctatctgggcgatcaggggactatgatgagggattgtttcattgaacagggaaacagtctgtattatgtgtttgaggatggagcgcgggctgaaaatacatgggttctggtggatgaggcggacggaaacggccacgaggccggttggtattacttcggcggaaacggtaaggcgtaccgcggcaccgactcctcttttaagaggaccgtggacggcaggcgttacatatttgatgagagcggtcttatgctgaccggatggtttgacgaggacggcaatcccctgggcgaggatgacaatccgctggagcacggcgtgtactacgcagatgaggacggcgcgttaaagacagagagctggctggattattcgcggctggagttaaaggggctggaggagctgtccagcgatatcagcggcagggattacgatgattatgaccaggtgtggctgtatttcaacaaccagtccaggaaggtaaaaagtaatggggaccgcgtgatacaaaggaatatcggcggcggcacatacggctttgacgagtatggaatcatgcttccgtggtggaccaaggtggcaagtgtcagcaatgcggacaagagcaatcccaccagcgatatacccacccggttctacgcagggtacgacggcggaagccttcagagaaatgtctggctctggatgtatccgtcggacaatctgatccaggatgactttgacgacggggagtacagctggtggcgcacggaccagaatggcgaggtctatcagaataaaataaagaaagtcaacggccggtattatgcctttgacggactgggcaggatgcagaccggatttgtgctctttgataaccgcagcacattcgttgcccactacgacatggacgcgtggtcatcggaggatttcatagagggaaatatatacggaatcgagaaggcggacctttatttcttctccccggacgagttgaacgacggctccatgcagaccggaaaagaactgaaggtcgaactggaggacggagtgtacacctttgggtttaaaagcgatggcatcgcctatggaaaccgcaaccgcttaaagaaggtaaatgattcctactatataaacgggcttcgactggaagcggacgaggaatatggttacggcgtggtccgggaggacgaaggttcctatcgcgtggtcaattccagcggaaagaccgtcagcggaaagaaaaaggttgtcaaggataaagacggaggatggctgattatcatcaataaccgattcgcggccagggtggacgacgagtttaagccgagatggtataagggggaagaaggaaccggattctaccattatgattcggataataaggaggataaatatgcgggcggtctgattgtcggaagtgatatggaaccgctgctggacgggctgccggaggaagaacgcttgaatttttaatgcgaggaggcgatgtgaagaatgaataaggaacgatatcaattatggaaacgttttgtttccttgattttgacaatttgcctgaccgtgggcctgggaacgtcgcagttggcggtggttgcatatgcctctacggaacttcccaatgagaatctgggaaatggagccagcgagggtacggcctatgcgtggattggtccgagaaccgggacaggtgagaaacctaccggcgccaattcctaccgtttcgacctgtgcggcttgcaggcagggcagacgggatattcccaaaacgggatcaagaccacctatagctggcagggatacgccacctatatccaggtaggagacggcaccaaatataaagccaatggaaacgccaacggagcggtggaagatttgaccagtatgggaattgagcttaagattgcactttccccaagcccggacaataaatatgtgtttgtggactattacgtctacgacaagacggggcagggaggggcccaaggccggtccgttaaacttggaaccggtacggacgtcatgatcggcggcagcaccgaagacgactatgccacggtttacaaaaataaccgcggtttccatatggtaaaccaacatgtgaaaaccaccttcgactgtatcaccaacgacaacagccttggggttacgcccacaaccacaagatggattgggcggtatatagactggggagacaatgtgtttaatgaaggcggcggcaattccctgagcgggaccgactcaggcatggcctactcctggcatttccagctccatccatatgagactgtacataaaagggtggcgtttgcaatccgggatacatcgtactatgtatccgcatccggagtggattcaaatgctgccgacggcacctacagcagtccctttaaaaccatcgaatacgccatgaggcagatcggagacaagaagggatatatctatatcatggattatccggagattacagcctccattccggtttccggttccagtaaggatattaccattgcaagtgcggattatgacaggaacggaaaccccaccaacgagaatgaggattatatcaaaacgttaaagcgagccggttcctttaccgggccaatctttgaagtgaccggggcaaccctgaagctgacggatctcgtactggacggcaatggcaatataagcggtgattctcttgtatcagccgcttccggccggattgagataaacagcggggcggagctgagaaattgtcatgggaacagcggcagtctgggcagcgcgctcagcgtaacgggaagcgcagccctgtccatgaactatggcagggtatccggaaaccgttcggagggtaagggcgccgtctactttaacagctcgggaagattcgacgtgctcaacgacgtgatgatagaggacaacacgaccccctcgggcgccaaggccaatgtatatctggagacaggacgggcgatcaccgtgacaggcgacttaaacgcttcaaggatcggagtcacgacagcccagcagccggccgcgtcgccgggaggaatctccacggaagcagggcaggagataaagatagcggcgccgcttgcggggagcggtgtggatacgtccccaagcccctttgcggataatttctttgcagatcaggcgaaagccgacggcaccggtctgtatgtgtcggtgggaacaaagaacctgtccggtgccggcgcgggaaatgataaaaatgcagtcatcaaacgaaacggtcttcagatcagctttgtcgtaaaggatgcgcagacaggcggttctatctccggcgtccccccgattccgccaatctcaaagggttcgggagagccggtggacattgcgcccgggccggatatcacgggatatgagctgtccggcgtggtcattgaacaggggacgccgccaaccctgacggcaaacctgacgcccggggcggacttcggccggattacgggaaccatgcccaaccaggatgtggcggtgagctatgaataccagaagatcggatcacagatcattttcaacagcaacggaggaacgccggaaccggagactctggttggcactgcagggaatccggtcaattcactgcttccgacgacaacacggtatggctacatatttaaaggctggagttcggtaaacgactgggacaacccccagtttattgacaggctgccggccgtttacccggagctgcctgtaacctactatgcaatatttgaggcggaccccaacgttaaattcaattatacggtagagcactccaacgcctctggggacatcatgtttgagaccaataccctggagggtgcctatagcgtggaggagccgattctggaggaaaaaaaggcggtcaggggatatacctggagcctggatgattccagcacgaccccgtcggaatataactttagcggcacatcggtgccgatcggccagtttaacggtgcgggtacatttaacggaacgatgccgggacaggatgcaaccatacgctacggatataaggtgagatatgacgaccccaatgccaggtctctgtttgaggtcctgcataaaaccaacaacgggacaacggtatccgcagaccagtcgggcctgtactatccggaaaatgaaatcactgcccagccggcgcaggtttacggctatcagtgtaccggttaccggtttgaactgggagaggatgcgggtgaactggcagacggcctggtaaacggcgtcagaggggattttgacgacggcttcgtcttcaacggaatcatgcccaaccagccggtacgccttgtctatctgtatgagtcgaccatccagggatatgagataacggtcaaatatgaagataacgggacggcggacagccgcctgacggacatcataccgcctgagagttcaggcccctatgaagcggacagcgacgtacagggcgtataccgggagcagtatggatacagcctggaggcgcatacggtcagtccggcggattcacagattcactttaacggcaatgactgggccggaatcatgccgaacgacgacgtcacaattaagtacaaacatgacaggataccggccctgtggggagatatcacatataagcccggcgtaaacggtaccctgcagggaggaagcggcgtatcccaggacgtacagacattgtcgggcggaagttttaaggccagcgtactgctaaacgacggcacgccggagggccaggcccagtcctacaccctggccgccataaaggaacggcggctcatgccgcagacccagccggtaaacaactattaccgcttcggcggctggtttattgacacggacggaaacgggattctggataacggcgagacaatcctgcctcaggattaccgattcacggctccggcgacaataactgctcattttgaggagaatccggatgcctggattaatatcaattttgcagcgggcagccatggttccatcgatgcaggggagtccctgacccttcgaaccacctttgacaagaaatggggggacattacgtccagccttccggcttatacgcctgaggtgaactatctggtggacgactggtatgtacagggcgaacctgtggacgacgatatgtccctgatcaacggccagacctataccatccagttctatccggacccggccatcttcggcacggaggtgaaggacccggaaccggccgcagggcttaacagtcagggcaagggccgcgttacggtattcggcaccacacaaggttataaatatatcctcacggaccttgatgggaaggtgctggaagtcaacaaggggaatttactcacaagccgcaccgtatttgacggtctgtatcccggtatgcgctatctggtgtacgaggcgacaggccagacaaaagtccagaccggagctatgatcgggactgcagaaggtacgctgagcagcggtgtggaggtattgacgccggtcgtggataccaactataagattctctacgacgaggaagacgaggggaaaacggagctgatcatccggccggcagacgccgcatcggactatgccgtgctggatagcagcggtcatgttgtaatggcgccgcagaccggcgcaggcggatggcagggcgtgtcgggaaatccgggaagcgtaagctttagcggtcttgactacaacaaggagtatacggtggtagcccgtcccaagggtcaaagcgggatcacggcggaaagccgcagggaagacggcagcgtcattaccacggatccgggcggagacctggagcttccggcttatatcattgagactttaaacggcgaggtggtaagcgcgggggatgaaccggtcggaggagaccgctatgaggagacccacaaaggcgatttggtgaaaattaaggcggaagcggttaacgatgaggaccgccccttctcccactggaaatttatcatcggctcggtggaagggctgggagacaagattaacacccgggaagccagcttcaccatgccggatacgaacctggttctggaagcggtatatgagcgggcggcaaccccaagcaacgccgccgtggtggacgaggttcggggaggcagccgggaggagctggccctggatccgggggagataccggacctggaggatgagctgaccacggatgcggaccgggagctgctggacgtaaaccacgcggacgtgacctataaggtagtttatagaaagaacagcgtgcgcgcctcggaatccaatgccatcaagatgggaggcagctacgatacggaccatgaagcggcctacaaggcggcgtgggggctggacgtgtccatcgaacggtatgtgaacggcaggaaggtaaaccgggcaagcgcatcggaggcatcctttaagacctatgtgcagcttggcaggcaggatgtggatatgatggactaccagctgtatgaaatcagcggggacgaggacgcggaaatgacggtaagccttgtgccgatggattatgaaccggaggaaacgggcggcctgttcacctttaccgccacggaaggacggcggtacatcatggtgtacaactgcgcgtaccgggtgtatttcctgaataacacggctccggatctttaccgctattggttcaaggtgcgaagggaggagtccccggcagattcctattatgagtcggagtttggagggctggaggaacagctcgactatttcatcagtccatcaggcgcggagtacagctatctgggctggagctaccgccaggaccgttacagagagtttgatccggaccgcggaataacccgcaagacctatgtatatgcgtactatgaggataacgagaaagaagtggacgatatccggagggagctggaggaagcgatccgggcagccatcggcataagcgacgaccatttcctgaagctgaacgagagcaagaaactgaaggaatacattgagacggcgctggaagttctggaccgcgaagagcccaaggcgaccattgaccagctggaggaagctctcagcgagctgaaggataagacggctccttacaaagaactgctggacgaccggtacgaccactacgacgaccttcaggaaagcggcaacaagggcggcagtaagggcggcggaggcggaggcggcggaagcaggaaaaagccgtttacaggaaccgcgtcgttgagctatgtgatagggaccaacggcaactgggaggagagcaccgggccgtccggcgagaagcagatgagcttcgtactcaacggaggaatgcgtctgaacgacatgtgggccaggttgacttacccggagggaaccagaccggaagacagcggttggtattactttgacgacaagggaatcatgcagagcgggtggatctgcgataaggcgggcaactggtactattgcaacacggagacggaattaccttacggaaaaatggtcacaggctggagaatggatccggcggacaacaactggtattacctggatccggtcagcggcgcgatggccctgggctggaggaatatagatgggaaatggtactatttctccccggtgggagccggcgtatatgcctatgaccctgtcagacagcggtggatctatggaggaggcgcaggacgcccgttgggcgccatgtataagaatgaaataacaccggacggataccggacaggtgccgacggtgcttggattcagtaggaggaaccggatgagaaagaggtataatatgaaatcaaagctggcagggatgctggcggcggccatggtgttttccatggccgccccgggatacccggcatatgcggttagtttcggggatccggttaagattcggttcgatccccagaacgggccgggagtacagctttccagctacagcagcgtggcggtggacggagctatggagggcagtctgtttgtggcgagcggacaggcgggaagtcccctgaccagttccgccaactttgcaggactgcccacggacaactttggctccggagaaaggccgaagctcccggcttttgatggaatctcatgggacggctatacgttcgacggctggtacggggccaacggcaaccggctggagacgcttccctacgcctttccgtatgattccgtgacaacctacaacgcggtgtggaggggaaatgaaacaaccccctatacattccgggttgagcattacagggattttaatccggcgaggaatgaggcgaacgacagcagcgcatggccggagaattatgaggatgctgatttaagaaaattttttgaatcatcctgggaaagcacccagatggccaacaatcccatatccgcaacttacagaagggatatcccgggataccggtttaagtctgtgattctaaagaacaacaaagtccgcaaatacggggaggagagcggatccggcaccatgacggagggcggggccagcatcaacacgtccaccaacgcggtaaggggcagcatgcccaacgacaacctgacggcggcgtaccgttatgaacctgatccggcgaaaaaattcctgatcacggtccggtatgtggatatggagggcaaccagataaaagccccggagagcagggcacttccggtggagtccgactatgtcatcgagccggcggtcattaactcctacctgattgaatcagcggaactgacagacggcggagttacggatctggacggcgcgggcgttatctccgctgaggatgcgggggtcagcctgaattcctccgattttcattttacaggaacgatgcccaaccaggccataacatttacctatcaatataaactggaccccgactttgaaaccatactgcgggtgaaacgggtggataaccacggcaatatcctgcaagaggaggagaggcggtccgtacagcccggcgtaccggtggaggtcgacgtagatgaactgccgggttatgtttatcccccgaatatcgcgtgggaggacagcttatcagacggatccctgaaccaggagacgaagaagctgagccttacccccaatcttcagggcggaacggtgaccatcacctacaccgaagagctgacggacgagaactactgggcaaaagtggaattctacaatggacagaatggatcctttaacgggagtacggcccctaagtttgtcaaaaagtccggggactacaccctgacccaggtgacggaaggtctcatgcccacgccgtcggcccactacagttttgacggctggtacaaggccacatccaacggaagcaataaaacgggaccgaggctggcagatgacacggtaatcaacgcttcgatcaaattatttgcgaattttgaggagacccagggcgaatggtttgatctgaaatttgtctccgggcctcatggcacgatagaggggaataagacaagccatgtcgagatcgggacatcctggtcgtccctcacgcttcccagcacccaccccgataatttctaccggtttgacggctggtttgacgaaaacgggaacaggatacagaactcgcagacaatcaatgcggaccagacctatacggcccggttcgtccccatcggactggaagatgattctatactgacaatgccggatgcccagggaaccatagcaggcgatggaagcggtaaggtgagcgtatcaggcgccaatgaaaaccgcaggtacgcgttgacggatatggatttcagggtagttgagaccaggctgggaagccagttgaggaataccggatttaccggattgaatccatgtgccagctactatgtctatgagcttaaattgaacgccaacccggaggcgggggtgatccttccggagaacctggatccggataccttcagtccgcccacgcgtgtgacggtaccggctctcggcggcaactacgatgtgcaggacgacgggaccggcatgaagcaggtggtggttgagcctgcaaagcaggggaccctgtatgcgatcctcaatatagaaggggatgtaatggacgttccaggcgcagatgaagacggatgggttacgccttccggcaccgcgccccgcgccgtgctcggcggtctggtggcaaaccagttatatgtggtggttgcaaaacagccgggagaggacgccgcgcctgccgataagcttttgctcggcacgcaggtagcggtgatcggaagctcacaggaacagcaggattataccattgcccttacaaatggcggctttatcacgaaaatcctgcgtgacggcgtgaccgttgactttgacgatgataaaacggcggtggtaaaggccggggatgtgatttccctggatgcggaaaccaccaacagccagggccaggcgttccgtcagtggagcgcgttgatcggcagtttgacgctggccgacaagaccagaaggaacccaagcatcaccatgccggaagggaatctggtgctccaggcaaattattacgctgcggagacagcgacgcccggcaacgcctccattgattatacccctaagacaggggcggtggccctcgacctgtcggatgacaggacggcggatttagtcgatgaactcacgaataacagcagcgaccagactgccatgacggcgggggtcgacgtactctacacagtcaatttcagccagcgggcgcccaaggcgtcggagtccaatgcggtaaaagcggaggccggcgacgatgcggtaaaagtaccgtgggcgttgacgtccgcactgacaagacatgtgggcggcagcaacaaggagatcccatccggtgtgaacagagagccggacatccgggtgtacgccgttctggaccgcagtatgcacggctatacggattaccagctgtggaacgtggagaatcaggacggggaatacatgtgtacggaggtgcccatggagccggatccgaacgacgaggattccgggtttacaggagtcgtctcctttgaggcaaatgtggaaagcacctatgtactgacctaccggaaagcccatgaagtgagaatcattgatgataagcgttccgcggaatacgtcatcagtgtcaggtccgacacggccctggaggacgcggatggttttatggacctggatatattcgaaccctatacggacccggttacgggagttgtatgggagtattacgggctgggaaagacggcctcctcgaataacggttatgataccagcgaaccggtgacaaagaacctgaccctgcatgtgctctatcaggtggaagacgatgcccggtggcaggaagcgaggcaaaagctattgagccagatttccatagcccagacgttaaagaacaacccgtcggtgagcgaagaggacaaggcagagttgggcgctgccattgacatcgccctggaagtcgccaacagaatctaccgtccgaccgtggacgagcttctggacgcctacaacgtgctaaaagcccttgtggattccatcacctcaggcggcggttttccggatgatcccgatcatccggacgatccggacaacccggatgacccggacgaccccaaccggccgggaggcggcggaggcggtgggggcggcggctcacgcggaggcgggagcagaagctttggaccgggaaatacctttaatgattacaagacctacgccgttggcacggaaggacagtgggaaagcgttggcgcagatgggagacagtggtcctttatcctgaggagcgggacaagccttaaagaccaatgggccaacatcaaataccaggatgcccggcagacctgcacctatcattttaatgcggccggaatcatggattacggctggtacgtggacgcgggtggacgctggtattatctcaacgagaccccgggagctgattttggacgtttagtcctgggctggcactatgatgttaaggacatgaagtggtactatctgaaccagtttaccggaggaatggcaaccggatggcagaagattggcgagcactggtatttcctcagcaccgcaagccaggccgggaggccgatgggctcgttgtatgtaaatgaaatgaccccggatggatatccggtggatgaaaatggcagatggatcagggaaacaccgtaaaacaggcggtgaaggttccggacagatgtctgcggttgcgttgcaaaggagtggaccatgctgagcgaagaaaagagccgtcagattgaaatggcaggtacagattgggcgtgtatgatgctcgtgtgtatcaatggacacgagaataatgagccctacggtgtcattgcgaattatcatctgtcccatcctgtaagtttcagaggaatccataggctgatactggcactcgacgaggtgtgcgaaatggtgggaagccccatggcaacaacagaaccgcgtttcctgctaaatgagtgggagcagcagtacagggcgctgaaggggaagcagaaaaaagagcccggaaagatcctgaccaaagaggatgtggcgaagaaaatgttcccctatatgacagctgcgaaggcggtcatcctggtccatgtgctgttcagacagcattcctccatgcagggcaggctccagtgcagttacacaggagcgcgttttatcgcgttccgcagcgccctggaactgatgcgtatgctggacgaggcaaacacctatatgtgcgggaaccagaagaataaggattgaaggatgtaatataaatgaaggatcggaggcagccatggtatcagccatggctgtttctgggatttcctttaagggagcaatcatggatcgtagtaagaaaaccggcattttaaatattctgagatttcactgcgcgtggcaacacgcgaattccgggctggcgggtgcttttgcagccgtcataatcgggggttttccccttgtgttcagagactattattttgatatactgaattttaaaacacaatttttttattgggttgtaatcatctttgcagccgtgttcctgatggtaaacgcggcgtttctgattctgtcaatctatctcgggtgtctgagggacccggtcaggggaaggcggattgacgcttccgactggtccatgctggattttatactgatagccgggatctccaccctgcagtcggtatttcctgccgcggccctgttgggaagcgacgggaggttttccggccttctgctgtggattgcctatgcgttcatgtactttgccgtaagcaagaacctgcggctgaggcaatggtatctggatctgtttctggcagccggcatggcggcctgcgccatcggaattcttcagtactttgacatagatcccatcgggttcaggaggatgatggagccggagcaattctatatgtttacgtccaccatcggaaatattaacacatatacatcctatgcagccctgctggccggcgcttccaccctgttattctttgtggaggagtcccggatcaggaaaaagtggtatttcttttgcatgtcggtctcgttctttgccctgattaccgggatgagcgataacgcctaccttgcgatattggccctgatcggactgttacccctgtatgcgtttaaaaacctgaggggagtcagtacctataccttcatactggcagtgctgacgtcggaattctggatcctgcacaggctgctgccgccgcattccggcgccgccggccgcatgggaggattgtatagggtcatttccgggtcccattacctgattgtcctggtggcagcgctctgggctgtatacgctgccttgcgccggatcatacaaaggctgccggacgcccatcctcttatgcgggatgggaacagggggagatgggcctggctggcgtttctggccgtgggggttattctgaccggcttcgccctttacgatgtgaatgtccgcgggaatacggggaactacggcggattggcgcagtacctggcaatcaatgacgactggggaacgcaccgctggtatatatggcggatcggtttggagcgctatcgcggattttccatcacacagaaactgtttgggaccgggccggatacatatgggttggtcgtcatggagaaatattatgatgaaatggtaaaacgttacggggaatttttcgacagcgcccacaatgaataccttcaatacctggtgacggtggggctggccggccttgcggcctatctggccttgctggttacatccgtctgcaaaatgatccggtcagccggaaaacgcccctatgtgatggcgattgcctttgccatcatctgttatgccgcccaggcggcggtcaatatcagcgtgcccatcgtgacccccgttatgctgatgctgctggctatgggagtatccggggcggatggaactgcataaggcaccccgggggacaagacgaattttacatatttttacatataagaataaacggaaaggaacgaagaggatgatcgtgattgttctgatacttttaatcgtgtgcctgataggagctcttgtctattgctgcactgctggtaaaattccatacgaccgccagacggatgacgacgcacagatggaatttcttcgcagatacggggaatgaggaggcaggttcattttactccaacccgcaaaggtcccgcacaatcttccccgcgatcagcagcccggctaccggcggaacaaaggcgatgctgcccggcgtggcccggcgtgcgccggtgtcctcctctgtgggccctggggtcaggggaagctcgggggaccagcagacggtcagttttttgacctggcgcgccttcagctctctgcgcatgaccttgcacagggggcagacgcttgtcttatagatgtcagagatttggaacagctccgggtgaagcttatttcccgtgcccatggaggcgacgatggggatatcgtggctctgggcgtaaacgatgagggccagcttggcggttacggtgtcgatggcgtcgaggatgtagtccacggggccgatctgcccgaagagctcttccagattgtcgggaaggacgaaggtttcaaaggtggaaacattgcatctgggattgatgtcggcgattttctccttcatcacctgggttttatagcgtcccacggtgctgtgcagggcgatggactggcggtttatattggtgagggacacggtgtcgttgtccacaagggccaggcttcccacgccgcttctggccagggcctcgatggcgtggcttcccaccccgcccaccccgaagaccgcaacgcggctttcctccaatgcccgcaggcccgtttccccgatcagcattccggttctggaaaattcatgaatcatatattactcctttcgcctgccgtcaaatggcacagcgtctatttttcacagtatccaatgtacatcatttttccgaaaatgtaaatcacgcctttgtttttggagaggataatgatataatgtcgctagacttatatccgcgccggttcggttccgaccagcgggaggaaaaacacggaccgaaccgtgtgcatcccccggagggaagccggcagggccggcgtaatgtcgctagacttatatcgcgccggttcggttccgaccagcggacaagcagatagatggaggcaatgatcaatatgagagatggatttatccgtgtcgcagcggcgacacccaaggtccgggtggccgacaccgtgtttaacggggagcaggtcatccggctgatggaggaggggtacgaaaagggcgccaagcttatggtgttcccggagctgtgccttaccgcctacacctgcggcgacctgttctcgcagcagacgctgctggacggcgcattggaggcgcttcggcaggtgatccgggctacggccgggaaggacatgctggtttttgtggggctgccctgggagcgcggcggcaagctgtacaacgtagcggccgcggtgaaggacgggaagcttctgggtcttgtgccgaaaaccaacctgcccaactatcaggagttctatgaggcccgtcacttctgccctggaaatgagattccggtggaggcagcgtgggagggcgggacggtgcccatgggcgccaaccttctgttctcctgcaagaacgccccgggcctgatgattggggcggaggtctgcgaggacgtgtgggttccctgtccgcccagcatccgccactgcatggccggggccacggtgatggtcaactgctcggccagcgatgagaccaccggcaaggacgcctaccgcagagagctgatctgtggtcaggccgcccgcctggtctgcggttatgtgtacgccaacgctggggagggggagtccacccaggatctggtgttcggcggccagaacctgatcgcggagaacggcacctgcctggcccagtcccgccggtttgtcaacgagaccatttatgcggacctggacctggaacgtctgaccggggagcgccgcaggatgaccaccttcccggccggggaggagatacgccgggcggaccactaccaggtggtggagttttccttctcggagccggattgttccggagcgcttctgcggaccgtggacctggcgccctttgtgccccacgatcagggacagcggagccgccgctgtgaggaaatcctctccatccaggccatgggcctgaaaaagcgcctggagcacaccagctgcagccacgcggtgatcggtatctccggcgggttggattccactctggcgctgctggtgacggtgcgcgctttcgacatgctgggccttccccgggaacaaatctgctgcgtgaccatgccctgcttcggcaccacggaccggacctacagcaacgcctgcaccatgacaaagcgggtgggcgcttccctgcgggagatcaacatccgccgctccgtgaccagccattttgaggacattggccaggacctggaaaaacacgatgtgacctatgagaacggccaggccagggagcggactcagattctcatggatgtggccaaccaggtgggcggcatggtggtcggaaccggcgatatgtccgagctggccctgggatgggctacctacaacggcgaccacatgtccatgtacggcgtcaacgcctcggtgcctaagacgctggtgcgccatctggtgcgctactacgcggacacctgcggcgagaaggagctggcggacgtgctctacgacgtgctggacactccggtgagcccggagcttctgccccccaaggacggcgagatcgcccagaaaaccgaggacctggtggggccctacgagcttcacgacttcttcctttattatatcctgcgctacggctacgcgccttccaagatttaccgcctggcgctgatcgcgtttgaaggccggtatgaggcggatgtggtatacaagtggctgcgagtattttaccgccgcttcttctcccagcagttcaagcgctcctgcctgccggacggtcccaaggtgggttcggtggccgtgtcgcccagaggggacctgcggatgcccagcgacgcgtgcagccgcctgtggctggaggagctggatcggattcacggacaggagaacaaattatgatcggcagcacgagcaataaacaggtaaaacgggtggtgaacctgcgcgccaaggccaaggcccggcgggaggagaattgctacgtggccgagggcctgcgcatgtgccgggagctttctcaggatcaggtggagatgctctatgtgacggaggatttcggcagcgtgccggggaaccgccgctggctggcgggatttccccacgagacggtaagcgatgtggtgatgaactacatggcggacacaaaaacgccccagggcgtgctggcagtggtaaagcagcggcattaccggctggaggagctgctgccgcaggccggaaagcagattccgaaaacttccgtcccggtcgggaagaacccgcccgccccggcctgtctgatgattttggaaacccttcaggatccgggcaatttgggcacgatcctgcgggcgggagagggcgccggaatcaccggtctggtgatgaaccgggataccgcggatatctacaatcccaaggtgatccgctccaccatgggctccattctccgggttccctttgtgtatgtggacgacttaagtgccgccctggcgcagatcaagtccgcgggcgtgcggctgtttgcggcccatctcaaagggacgaataattacgaccaggaagattatactggtaatattggttttcttatcggaaacgaggctgccggcctgacggaggagaccgccgccatggcggactgctacatcaaaatccccatggccggccaggtagagtccctcaacgccgcggtggcctcctcggttctgatgttcgaggcggcccggcagaggcggaataacagccggggatgatctggcggcccgcaggtttcaccggcaccgcggttgtttcgaccgcccgcagtccccacttctatacatagatcgttcacgccggaaacgcgggcctggctgccgtccggcggaaggatctgtggaacagattgatggaaggagtggatcaaagaatggcggtaatcgcgtggatgacggtttttctggcgctgctgggactggagatgatccagaaatccctgacgaccctatggtttgcgggaggagcgctggcggcggccgcggcagcctttctgtacgccggtatgaaagggcagctgatgtgttttgtgacggtttcatttctgctgcttctggcggtcaggccggcagtaattctggcgggccgggcggaccgcggcagccggcgcagcaaggggaggatgcatggagttacaactggacttgaataaggaatacggcatcgtcctggaaggcggaggagccaagggagcctaccaggtgggcgcgtggaaggcattgaaggaggcgggaatccgcataaagggcgtggccggaacctcggtgggagccctcaacggagcgctgatctgcatggacgatttttccaaggccgagcggatctgggagaacatcagttattcccgggtgatggatgtggacgaagccctgatggagcggatcaagaatttcagtctgaaaaacctgcccgatctcatcgccggaggcacccggctgttaaaggaccggggctttgacatcgccccgctcatgggcctgatcggggatatggtggacgaggaacggatccgcagctcgccaagagacctctacgtggtgacctattccgtctcggaccgccagcctctggtggtgaacgtcaaggagacgcccgagggcgagatcggcgacatgctgatggccagcgcctacctgatcggcttccgcccggaacggctgggcggtaagctctacatggacgggggcggcgtgaacaacgtgccggtggacgtgctgatggacaaaggctacaaggacatcatcgtggtgcggatctacggcctgggcgtggacacggagcgccgcctcaaagtcccggaggacgtgaacctccatcacatctgcccgcgccaggacctgggcggaatcctggaatttgaccgcaggcgggccaaacggaacatggtgctgggctattttgacgccaagcgcatgctttacgggctggccgggcgcgggtactacatcgacgccccctccggggagccctactatttcgacaagatgatgtccgagcttccgcagcttttggcctatctgaggccggagatggaggaggaaatcagccggttccccaacggctaccgctattacacggaaacccttctgccgcagatggcacgggagatgaagctgaaggagggctgggactacaaggaattgtacctgtccctgctggaggagcttgccagacagtaccggatcagccgctttaaggtgtatcaggtggaggagcttctgcggatcattcaccggaaggcgggaaagaaagttttaaaaggaatctgattatgcatactttatgcagcggttccggaggtgagagaagaaaaaacctcgattttgaaagaaaaatcatctttgaaacggattgcataacctgtatatttaatattaattataccaatgattgataaaatatgcaatccaacccttgacatccggctgctcctgtagtaaattatagtataaatatttatatatgctaataaatatgcatactgtaaaaaaacggaggaagcagccatgaacttaaaaggaaggcattttttaacattaaaggactatacggaagaggaaatcctgtacctgcttgacctgtcggcagagctgaaggacaagaagaaaaaagggattctcgtggacacgctgaaggggaaaaatgtggccctgatctttgagaagaccagtaccagaacgcgctgcgccttcgaggtggccgcccacgacctgggcatgggcactacatatctggatccgtccggctcccagatcggcaagaaggagagcatcgcggacacggcccgcgtgctgggcggaatgtatgagggcatcgagtaccgcggatttggccaggagatcgtggaggaactggcaaaatacgcaggcgtgccggtgtggaacggtctgaccaatgaggaccaccccacgcagatgctggcggatctgctgacgatccgggagcatctgggacatttaaagggcgtgaagctggtctatatgggcgacgcccgctacaacatgggcaacgccctgatgatcgcctgttccaaggtggggatgcactttgtggcctgcgcgcctgagaagtatttccctgcgccggagctggtggcgcagtgtgaagcctttgctgcccttagcggcggctccgtgaccctgaccgaggatgtgaacagcgcggtgaagggcgcggacgtgatcgacaccgacgtctgggtgtccatgggcgagccggacgaggtctgggaggagcgcatccgcgatctgacgccttacaaggtgaccatggacgtgatgaacgccgcgggaccccaggctattttcctccactgcctgccctccttccacgatctcaaaaccaagatcggcaaggagatgggcgagcgttttaatgtaacggaactggaagtgacagatgaagtattcgaatccgcccggtcggtggttttcgacgaggcggaaaaccgcatgcacaccataaaagcggtgatgctggctacgttgggagaataataatatatgatgcattcacagtcgaggaggggagaccggcattcaggcgtatttctggatgtgttccacctcatcgtaggtattttagtggtagtcctcggactgctttcatttctcaacccggagggccatgaggtgctctttccactggtatttttcctggccgcagcgctgaacgcggtcagcggcgtgtttgagttgaaaactcagggacatgacaagaaaaagcgcagaacgggcataatacacattttgctcaccgtggtcctggctgcggtgggcgtgctcagcgccatcagtatctgggggtaaatgaagccatgaaaacagagattttaaaaatgctgcgggagtcggagggatatctctccggccagcagctctgcgaacagcttggggtgtcccggacggcggtatggaaaaccatcggacagctcaaggaggaaggctaccagattcaggctgtgcgcaataagggataccggctggtacagggggcggacgtgatcacccgggccgagctggtgagcagcctggattccgcctgggctggctccaacctggtctattacgacagcacggactccaccaacacccgggcaagacagctggcggagcaaggcgcgccccacgggaccctggtggtggcggacagccagaccgccggaaagggccgccgtggccgtcactgggaggcgccggacgggactgggatctggatgaccctgatcctgcggccggagcttgagcctcagcgcgcgtccatgttgacgctggtgactgccctggcggtggcggacgccatccgcggcctgaccggcctggaggcggcgatcaaatggcccaatgacattgtctgcggcggaaagaaggtcgtgggcatcctgacggaaatgagcacggaggcggagtggatccgctacgtgatcgtgggcatcgggatcaatgtgaatatggatggctttcccggggagctgggaaaaaccgccacctccctgaagctggagctggggcggggcgtgaagcgcagcccccttgtggcggcggtgatgaacgccttcgagaagtattacgccctgtttgaaaaggcgggcgacttatcgggcctggtggacacctacaaccgctggtccgccaacacgggccgccaggtccgtgttctggatccggccggagagtaccagggagaggcccttggtattgacagccagggggctctcctggtaaaatgttccgaaggagaagtaaagtccgtgatatcgggcgaggtttccgttcggggcgtttacgggtatgtgtgatgacgaaacatttgtatgaccggatacaggtcttggaacgagaagatgaattggaccgtcagcagcggcttaaggcaatggccaggccgctgctttcctggtatgagggacatgccagagcccttccctggcgcgacgatcccacgccctaccgggtctggatttcggagattatgctccagcagaccagggtggaggcggtaaaaccctattttgaacgttttatggcggccctccccaccgtgcaggctttggcagcggtggaggatgaccgcctgatgaagttgtgggagggcttggggtactatacccgggccaggaatttaaagaaagcggcgcttatgatcacagagcgccatggcggcgaattgcctggctcctacgaggcgcttttggcccttcccgggatcggaagctacacggcgggggccatcgcctccatcgccttcgggcttccggttccggcggtggacggaaacgtgctgcgggtgatttcccgtgtgctggcggaccgggaggacatccggcagccgtcggtcaaggccaggatggagcgggagctaagggagatcatgccccgggagcggaccagccagtacaaccagggcctgatcgaggtgggagccatcgtctgcgtgccgggcggggaaccgcgctgtggggagtgcccaatggaatccatctgtctgacccgcaggcaggggctgtggaaggagattccggtgcgcggcgctctaaagaagcggaaggtggaggaactgaccgtctgcctgatccggcggggggaggaggtcgccatccataagcgtccggacacggggcttttggcttccctctacgagctgcccaacgtgccgggacatctggagccggaccaggttcccggggccttcggtttatccgcggacctggtggaggcggtggaaccccttcccgcggccaaacacattttttcccatgtggagtggcatatggccggttacgccgtgtctctgagggagggcggggaaatgaaccgggagggcgcgtttttctttgtagagcgcagcgcggtgaaaggggaatacccgctgccgggcgcatttaaggcgtacaccaaattgatttaggattttgttggataatggaagaaaaaggggacatactttggaaaggagggaatgtggaatgaaaaaactgatgtttatcttcaatccgcgttccggtaaggaacagatccggggccagctcatgggaatcctcgacattttcaccaaagccggttacgatatccatgtccacgtgacccagagtcagagagactgtgtggagtgggtgaaggattacgcggaccggatggacgtgctggtggtgagcggaggggacggcaccttgaacgaagcggtgacaggtatgatgaatctggagcgcatcccgctgcttgggtatattccggccgggtccaccaacgatttcgccgccagcctggggcttccaaagtccatgcaggaggcggccgccgacattgtggagggcagcccctatcccatcgacatcgggcgcttctgtaaagaccagtatttcgtctacatcgccggtttcggagccttcacggaagtgtcctatctgacgccccaggacaagaagaattggctgggccacaacgcctacgtgctggagggcgtaaagagcctggcgggcttaaagcccaggcatatgcgggtggagtgggacgaccaggtgctggaggaggattttgtgttcggaatggtcaccaacaccatcagcgtgggcggcttcaagggcctggtgaaccagtccgtggccttaaacgacggcgagttcgaggtgcttttgatccgcatgcccaggacgccggtggacttaaccaacattatcaactacatgttcctgaaggaagagcccaacgagtatgtatacaagttcaagacccgggcgatccgcatggtgtcggatgcgccggtggactgggtgctggacggcgagttcggcggcagcaggactgaggtggagatcgtgaatctgcagaaaaagatccggattctgcgcagaaacgacgagctgatgtgaggcccaagggcttttttggaggaaaatggggcttgagggcagttttcttcgccgattttcccgccttctgaactgttacgtcgattttgataagtttttccgtaaatatgttgaaaagtatcgattgatcgtatataatgataagttgtagaagtttctccacaggagcttctgcgtaggcaacctacttactttcaagcgaaaggacgtttatcagtggaaaaggacgattttttaaaaaagctggaaaagctggttgaacttgcaaagggcaaacacaatacgctcgatgccggggagatcaacgacttctttgccggagacagcctgtcgccggagcagatggaccacatttacagttatctggagaaccgtaatatcgacgtagttcccgaactggacgagaagatgctctcagaggaatccgcgctcctggacgatctggatttggatctggaccttgatgatgacagctttatgaaggatacggaggaagaggagatcgacctggatgcggtggacctgctcgagggtatcggaaccgaagatcccgtccgtatgtacctgaaggagatcggcacagtaccgcttcttacggcagatgaagaattacagctggcccagcgcaaagccgagggcgacgaagctgcaaaagagcggttgattgaggccaatctgcgtttggtggtcagtattgccaagcgctataccggcaggggaatgagcttcctggatctggttcaggagggaaatctgggactgattaaaggcgttgaaaaattcgactatacaaagggttataagctaagtacatatgctacctggtggattcgccagtccgtgacgcgggcgctggcagaccaggcccgcaccatccgggtgccggtgcatatggtggagacgattaacaagatgtccaagatgcagcgcaagctgacgctggaactgggctatgagccttctgtgaccgagctggcggaggctttggacatgaccgaggacaaggtgatggagatcatgcagatcgccagagagcccgcttccttagagactcccatcggcgaggaggacgactccaacctgggcgattttgtggcggacaacaatgtggtgacccccgaggggaatgtggagtccgtgatgctgcgcgagcacatcgatgcgctgctgggagatttgaaggagcgggagcgccaggtgatcgtgctgcgcttcggcctggaggatggacatccccgcacgctggaggaggttggcaaggagttcaacgtcaccagggagcgcatccgccagatcgaggcaaaggccctgcgcaaactgcgcaatccggtgcgcagcaagcggatccgggatttcctgtaagcttcgggtatagagtgaatggaacgttgtgcgggaccgccggtagggcggccccgtttttcgcgtttcgaaaatgcggcgggcgccggaaaataccgcggggcgccggaaaatggcgtcgcagcctgggaaaatagaggccgctgttcagagcggcggggaggagcgcgaatggagcgagagacgacaaaaaacggccggggcgcagacacgggccggacggcgcagaagcgcaattaccagcgggagctggacaaggtgatcgagggtctggagcgggaagggaaaaggcccaggctgctgctgcacagctgctgcgcgccttgcagcagctacgtgctggagtacctttcccggtattttgccatcacgctgttttattttaatcccaacatctatcccccacaggagtatcaggagcgcatcggggagcaggagcggctgatccgggagatggagtgcgccggggcgctgggaattccggtggaatttcagggcggggagtatgagccggaggaattttaccgggcggtgcgggggcatgagggagaccgggaagggggagagcgctgctttatctgctatgagctgcgcctgcgccgggctgcccgggcggcagtagaggggaagttcgactattttaccaccacgctgtccatcagccccctgaaaaatgcaggaaaactcaacgagatcggggagcggctggccgcagagtacggcgtgccctatctgatgtccgatttcaagaaaaagaacggctacaagcgctccaccgagctgtcggcccggtacggcctctaccggcaggactactgcggctgcgtattttcccgggaagccaggaggggtaaggacggagccgccgggacagaaggcggggcggcggacgactgtgaaaaagtttgtgaaaaagttgaccgcgaagtggccgattaacttgacatcaatgggtgattgtaataaaatcttggtaggagacatgcctttctaaggctcccaaacgagtataaaatatattaataaggagaattgatatgatcagtaaaactttaaccgttgtgaatccctccggattacatttaagacccgccggcgttctctctcaggctgccatgaagttcaaatgcgacgttatcattgagtgtggggataaaaagatcgttgcaaagagcgtattaaacgtgatggctgccgggatcaagtccggcaccgagatcaacctgatctgcgacggcgaggatgaggaagaggcgttaaagactctgtccgaggccattgagagcggactgggcgagctgtaagtccatccctgtatgattggagtcccgggactctccatacgggaaaatcagaattttaagaaggggtaccgcattcctgaacggagcggtaccccttttttggtgcgcccggcggttttttccgaaggccggaggcgtacggcagaacgcggcgcggtccgccgggaccccgccgcgcatttacagattaaagatcaaaataccgttggaactccgccggatggggaatctgggatagctcccggctctcctggcgtttcttccccagccagatttcaatgagacgctccgggaacacgccgcctgcggtcagatagtcgtggtccgcttccagggcgtccaatgcctcgtccaatgtcttgggaagggactggatcttcgccttctcatcctcgggcaggtcatagaggttgcagtcaaagggaccccagccgtgggcttccgggtcgatctggtttttgattccgtccagtccggccatgagaatggcggcgtaggcatagtaggggttggccgtggcgtccgggttcctcagctcgaaccgcttggccttcggcgtttttgcgtaagccgggatgcggatcacggcgctgcggttggaggtggcgtagccgatggtcaccggcgcttcaaacccaggcaccaggcgtttgaaggagttggtggacgggttggtgaaggcgcacagggacgggacgtgctttaacagtccgccgataaaatagtgggctgtcctgctcaggccggaataaccgttctcgtcgtagaaaacgggctccccgtcctttaacaacagcatgtgcacatgcatgccgttgcccgcctctttgtagatgggcttgggcataaaggtggcggtccttccgtcctggacggcggcgttgtggatcacgtacttgatgatcatggtcttgtccgccatgtccaccatatcgcccagctctacctcgatctccatctgaccggagccgcccacctcgtggtggtggtatttgacgtccacgccccagtcctggagcagcatgcacatcttgctgcgcagggtgtaggccacgtcctgaggcgccgcgatgtggtatccgccgcctccgggcacctggaagcccttgttgtccgcggtctcccggccgctgttccaggacgcctgccgtgtgtccacggtgaaggccatgcgctggggctctaccatgtagctgacgttgtcgaataaatggaactcaaactccggcccgatgagcatctggtccgcgatcccctggtctttcatgtactggatggcccgcaggctcacgtttctgggatactggtcaaaggggcggttctccttcccgatgacgcagacgtccccgcacatggtcagggtgggaatctccgtaaacgggtccaccaccgcggtctccgggtccgggataaagaccatatcgctcttctccaccggggcgtacccgtagttggagccgtcgaagccgatgccctgggtgaaaatatcctcgttaaagcgctccaccgggatcgtgatgtgccgccaccggccgtttaaatccgtcatcttgaaatcaatcattttgattccctgctcctggcagatttgtaatacttctgtactcttagacatgttttcccctccaaaattggtgtgttcgcgaaacgcgttcgttatcaggctgatgataagcaccattttcttattataccatagtttggggagattatggccctttatatttgccaaatggaaatattttatcggaaataatgctgcgatgtgccgccggcccggccgtctgcccagctgcggattcccggcggaatcacagggcctttccctgttccagccggtccagatagttcatgagccgtcctttctcgccgttgatcaccagctcctccgggaagcccacggactccagcagccggatggcggctcggtgatcccccacgaagtagcgggagtgggcgtcggagctgatcagcacggggacgccgtattccttgcagagcagggccacggcgcggcaggtttcggcgcttccggggcgtaccttaaaggagctggagttgatttccaccgccttgccgtgctcccggcaggcttttaccacggcctcgtagtcgcaggcgaacaccgggttgccgcagtggcccagacagtccacgtccgggttggcgataacgtttagccatccccttgtatgctgctctgaagcagccggatcgatggcctccacgtgataggaggccaccacgaaatccagctgccgcagcacgtcccggtccagatccaggccgccgtcaaaatcttttatattgacctcggctccggctaccaggcggaggccgtggaccgccttcggaagtcctctcatacaatagaaatggtgacggattgcaccgtccatcatgccgggtccgtggtccgtgatcccgatggctgccaggcccagctctgcggcgctgcgggccatctcgtccagcgagctgtaggcgtgctggctcacactcgtgtgggtatgtaaatctgcaactgtgcgaatcattgatatcaactccttttctgattcaaatatccttgtttttggttgtggaaatcagtataacacaattcagtgaaaaaataaatatattttactaaaatattgttttaaatttactgtaaaaaccattgactttccggtaaagtgacagtataatcaaccatataagcgacatcgcagcggaaaaaaagtgaaaaatgcccagaacaggagcgctgcgtctgctggaaagtagtgggtaaaatttactgaaaacaaggaaacaaaaatgcattgatcatgagaacaggaggatgagaaaatgagaaagaaaatgttgagcgcactgttgtgcacagcggtagcggcggggatgctggcgggctgcggcggcggtcaggaagcgggcacaaaagcggcggagacgaaagcggaagccaacgcccagggggacgcggcggcggagaaggagatcgtcaccatcaagctgtcccacaacaaggactatgtcacgatcccggaggccgtgatggaggcgggcaaacggctgaatgagaagtacgccgccgagggaaagaatatcgaggttcagtttgagaccgactaccagcagatcgactggacggattaccacaacaacatcgtgttttcccacaagagcggggacgcgccggatattttcacctgcgatgcggacattgccggatacgcggatgccggggtggtgatggatgtgtcggaccttatgaccgacgattttgtggacggcgcattcaacgcctgcatggtggacgggaaagcctacgccattcccatggacatgcccttccgcgtgatctactacaataaggaggacttaaaagccatcggctggaccgacgaggaggtggaggccctgcctgagaagatccggaacaaggaagtgctcttcgacgactttatcgatatctgccaggaggtggtggagaagggcggagcccagtacggcctggttcaccgtcccagcgcaggcaatgacttctacgacattatcaatgccctgggaggggtctactataacgaccagaaccagctggtgttcgacaaccaggggattttgaagttcttccagtttacctatgacaacgctcagacgcgggggattactccggacaatttaaaccagctgggctgggataccatcaacaagatggtgggcaccggcgaggccttcgcctactacgggcctatgttctccgccacctatgtggctcaggctgcggggcgttccactgaggaattcgccaagcaggaggcctttgtgctgttcccggctgcggacgcgtccggacagccctttgcagtggccgcgcctcagaccatcgccatcagcgcggacaccaaataccccgaggtctgtaaggacattgtgcgcgagatgattaccggttcttcggatatgatggccagacatgccgccaccatttacaccctgtcctccgtgaaaaaggccaacgaggacccgcagatcacggagcatcccctgctggccggggtgacctatatgacggactacgccgtcacgccgccggcagtggagggacagacaactttaagaggctatctgtttacggagatcgtgactctggagctgggacagaccacacctcaggagtcctttgagaacgcgaaggctcaggcggagctcaacatcgacggactggtgcagaaataacaggcataaggttcccgttttcgggaacctttcccacttgaatgcaatgagaggatacgcgcatgaacaaaaagaagtataaaaatgggcaggcgtacgcatttcttagcccgtttctcgtattggtggcggtgttttacatacttcccgcctttattacggtggccatgtcctttaccaatctggactcggcctttcagtggcatttcaccggcctgaagaactatgagaaaattttccgcgatcccaacaccctgaccattatccggaacacggcggtatttgtgctgattgccatcacgggaactgtggtgctggacctgttttttgccgtgatgaccacgtattttatcaagagcgagcgggtttccggggtttttaaggcatttcttatgatccccatgatcacgcccgcggtggtgtactccgtgctgtggatctggcttctggaggccagcgattccggcctggtcaaccagctgtacacggctttgacgggcagcctccccttgaactggattgccaagtaccccttccagatcatcctgttcgccacggtcatggtcagctttgcctacgggaccaccatattttccagcgccatcaagagtataccggaaaaccagttcaaggcggcccgggtggacggggccagcgagtgggagatcgtaaagagcatcattttgcccaacatccgctaccacatccagtttatcaccctgtgggagaccctggggcttttaaccaactatgtgaccattatgctgatcacggacggcgggccgggaatcaagacggaggtctgggcgctgagcgcctaccacaaggcgtttcgggatcagcagtacggctacggcgcggcgatctccatgctgctgatcgtggtggtgctgatcctcatgctcttcgtcaaccgggttatgaatcagcgggaccgcagatagggaggaaatggtatgaaacagacattgaaccgacatgagaaacggaatcagcggaccgccgtcatcgtgatgctggccatcacggtgcccatcctgctgatctacggatcgttctttaaaatggcgtttttcgacgacgccgggaactttactctgggaaatttccagtttctgtataaaggtatggaactaaagcagacaaagatcgagccggtgggcaaggcgctgaccaactccatctttttcaccgtggtggtgaccgtcaccgaggtggtgatcagctgtctgtccggctatgcgatttccaggctggaattcaggggccggaaattcattcagtacgccctgctggtgctgcgcatgtttccacacctgctgctgctcatcggcgtgctctacgtgctggtggagctgaagctggccaacagcatgctgggtgtgctgctggtggcgatcgccttccgcataccgggttcgtcctttattatcaagaactttttcgacggcataccccgggacattgaaaattccaccctggtggacggatgcagccgggtgagcgcctttttccaggtgatcatttacctggtgaaaccgggcatcgcctccatctccgtgttctcattcctgagcgcatggtccaactacatcctgttcaacaccctgattttcaattccaagacgcctgtgttcgccacctacctgcggtccctgtccagcaacgagcagatgatcgccagctacggggtgtttgcggctatggccctcgtgtatatgttaccggttatcgtgttcttcctgatctcccagagatccctgatggaaggaaatattgccagcggaaaaggagtgtagcgtaaaatgatcaagatcgaaaatctgagaatggaatttgagggcggcgtgaccgctctggacggaattaacatggagattcaggacggggagtttatcgccctcctggggccttcgggctgtggaaaatccaccaccttaaactgtatcgcaggactccttgatcccacggacggcaccatccgttcggacgaggtggatatcacaaacaaagcgcccaaggagcgcaacatcggcatggtgttccagtcctacgccctgtacccccacctgcgggtgatcgacaacatcgcctttccgctgaagcagaaaaaggtggccagggaggagcgctatgacagggcccggaaaatggcggcaaagctgcagatcgagcatcttctggaccgcaagccgacccagctctccggcgggcagcagcagcgcgtggccatgtgccgcgcaatggtgaaggagcctaaaattcttttgttcgacgagcctatgtccaatctggacgccaggcttaaaattgagatccgcgaggtgatcaagaaattgcaggctgagacgcggatcacctccatcattgtaacccacgaccaggaggaggctatggccatcgcggaccgcatcgccatcctggacaacgggcggattcagcagttcgatacgccctttgagctttaccagcacccggtaaacctgtttgtggccaatttcatgggaaatccgccaatgaactttatcgacgccaggctgatgaagggggagggaggtctctgctttctggtggacggacagacggttcccgttcctccggccagggccaaagctctggcgggcagcctggaccgcgaggtgaagatcggcgtccgctctcaccagatgcgtccggtggaggcacatgcggcgggagccatccgcctgaaggtgcagatggtggagaatctgggcaaggaactgctggtacaggcccaggtgggcaaaaacctgatccgtatctcggaggaggataccacaaagtatgcattttacagggggttggcggacgtgaagggggagatgggaattctcctgaccgaccagatcaatgtgttcgacagcgagaccaaggccaacgtgctgatggagcaataagcggaaagcgggggccatatgagaaaattgattgcagaccgggatcatgtgctggtgggaggccaccggggatgcgcgtgcgagtattttgagaatacgattcccgccatgaaggagggaatccgccgcggagcggattatctggaaatcgatcttcagctcacaaaggacggtgaaatcgtggtttaccacgacacggagctgagcaaaaaatgccgcctgcgcgggtatgtccacgagcacaccctggaggaaatgcagaaggccctgccggtgaacacgctgcgggaggtgttcagctgggcttcgggaaagggcgtctgcctggcgctggaattaaaaagcgtgcccgtggatatgcaggagcggggatttgcgctggtggagcgcctggcggacctgaccggggaatacggcatgggggagcaggtgttcgccttcggcgcggactatatggtattaaaacatttaaaacaggtgaatccggagtttcacatcggcctgatcgtgccctttgtacccgcggacccggtgaagctgatggaggagatggatgccatggtatatctctcctacgtttataacatgacgccaaagatcgttgaggatttgcaccaggccgggtattttgtggacggggcgatcctccgggaagaaaaatggacgcggctggcgcgggaactgggggtggatatgtatgagagcgaccggccggagctggaaaagaggacggcggccggaaagaatgtgattgaaaaacaaggaaatatttagtacaattaataaaagtgcgcgggccggattaaaaaagcccgcatccaagcggaggaaggcaatatggcgacattagaggacgtggcatcggcagccggagttgcggttacaactgtatcgcgggcgctcagaaacgacgctacactgaagatcacaccggagaccaggaagcggattttttcggctgcggagcaggtgggctacgagcagaaacgccagaaaacccttcaggcccggaaaaacattgtcatcgtccataaggacactcattttgacaatcagatggacaacgcctactatttttccatgcgcaccggccaggaaaacgcctgtatggagcggggaatcagctaccggtacgtgccccagagcatgctgcgccaccaggcggaggtctgcgacggcgcggtgatcatgggcaatttcagccgtgaggaggtggattccattgccaaagcggtaaaaaccccgcatctggtattcaccggtctgatgaacttttatccggagcggatggactggatcacctacgacgtctacggggcggtggagctgatggtgcgctgcctggcggaccagggcgttgggaccgtggtttattttggcggcgatgagaccccggatattttgccgcggtacagcaaacgccaggtgttttcgagcctggcgggggagagcggcctggtatgccgcgagtccgtgtacggagcccacgggacagagaacggctgccggatgatgcttgaatggctggataaaggggagaagctgccggacgcctttgcggcctccaacgaccccatcgcaatcgggatgttaaaggccctggcccagaggggaatccgggtgccggaggatgtgtccgtgatctcgatcaacggggattcccccggcgagttcatgaacccgcccctgaccaccgtggacgtgctcaccaagcagctgggcgcggagacgatttacgccttgctggatcagatggagacgggaaggacgtactacaagaaagttgaattcgctccccggctgttgaagcgggggagcgtgaaataagccgtggcttaaaaaatgacctggggatgggggatattcttggcgtgtttcaggcctacgcccaattccccaaacataatgccgcataaatacggcttgcatcgcacatgctttgaatcgtacagtattcattcactgaatgagccagtgttatatcccccggtcccagcacgattgtgggcagatgaaacatgccggcggttgtcacgccgtttgtgctcgcctccatctggaacaggaccggttttttatcctgtatggtttcacaggccgtttcggcggcgcggaccaggacatggtttttttggattttccaagccgggagaaaagaatggaatgtaaattctttcccagtccagcttttggacggaatatcacagaagcgccatcttcccttagtcccttcggtcagacggtccatttcttcggagataaccgcttccgattcccccactgccagacgcctgtccagtataatggaggcggtctggggaacggaattgttggaggcggtgctgcagccgatgttggtcagggccaccgagcccttctcgccctccctggcatccaaaacagctgcctgttcctgcacctgatgaatgatatcttccatgaggtacaccggattcacgccgtttgcgggattgctggcatggcagcctttcccgtctaccgtcacctcaatcagcgccctgcctcggtggcccgtggcaatcttcaagccggtgggctcgcatatgacgacaccgtcggggcgaaggccggaagcggtcaaaaactgtcggaccgcttctccgtcaaaatcttcctccatggcggaagcggatacgtaaatggtggtattttctgaaagtcccgctctttttgcgatacaggcgccatacagcgaagcggccagtgggcacttcatatctactgcgccccgcccatagagtttgccgtctcgaatttcgccgccataaggatccacatcccattgatcttcatcgattaccgtcactgtatccatatgggaatcgaaaaacagtacctttggcccggacccgattcggccaattacgtttcctgtttcatcgatccgcacttcgtcatatcccagcttctgcatctccgcctcaatcagtgcagcagcttctttttcttcacaggtcatgctttttgtctgaatcagttttcttgcaaatgcaagcagatcatccgacagttcggccatcatccggtcgatttttaatttgatcgtatcattcatggattttgcttagcctcccattccgtttttatcaggattactgtggcgcgccctcccacacaatatgtttaaaacgctccggatcggtatcgccttcggtcgaaaacagaagcactttggagtgttcgttcagtctgacggcctcttttaagtccctgtaatcctccatagcggccaggacagccagcgcgccaaaggggactgccccggattcaccggagatcacctgggggtcgccctttaacggagcggccagcattctcatcccctttgcagcgacccagtcaggagcagcaacaaaaacttctacgtgattccttaaaatgtcccaggaaaggatattgggcgctccgcaggctagtccggccatgatggtctccatgctgccgcctactatgcggatttcgccgtccccggcggccgcacctttgtagagacaggcggctgcctcggcctccaccaccacaaataccggcggattgtccggatattggttaacaaagtaaccgaccaccgcaccggccagcgagcctacgcctgcctgtatgaaaacatgggtggggcgatcgcatccgaattcctttaactgttcttccgcctccatcgccatggtgccatagccctgcatgatccaggcggggatttcctcataaccttcccaggacgtatcctgtaccaccacgcctcgcggagtcttggccgcttcctttgcagccaggagaacgcactcatcatagtttaaatctgtgatatcggctgtcgcgccttcttttcggatgttctccaggcgggctttggtggtacccgcaggcatatggaccactgcgttctgatgaagcctgcgggcggcccaggccacgcctcttccgtgatttccgtcggtggcggtaaagaaggtcgcctgcccaaatttctgacgaagctcgtcggaggtcaatacggagtagggcaggtccccaacatttgttccggtctcctttgcaatataacaggctatggcgaaggagccgcccagcaccttaaatgcattcaggccgaagcgatacgattcgtctttaacataaatttcctgcactcccagatagttcgccatctgatcaagctttgccagaggcgtccgcgtgtattgcgggaaactctcgtgaaaggctttggcccgttggatctcagatgacgccattacctgaagctgtccgtcctctgttttgggcatccgattgacaacccatttcatagcatccatcgcttgtttcctcctgtaatttcttttagaacggcccccattgaatcatctgtgcaatgatcaggaaggctgcgcccacgcaggtccagatggcaaatagcgggagaatgaacttcagccacttttcataagggacctttgccaggccgagggtcgccatcaggtaaccggcaaccggatataccacgttggagaagccgtcgccgaattgcagtgcaagaactgcggtctgtcttgtgactcccaccacatcggacaggggcgccataatcggcatggaaacaaccgtctgaccactgcctgaattgaccaggaaatttaataaggtctgaactgcaagcattccaaccgcggccagggcgctgggaagtcctgtgatcagttgagaaagtccgtaaacaatggtgtcaataatcatgctctcattcatgattacgctgatgcctctcgccaggccgacaatcaaagcgcctaacaggacgtcatgacagccttccataaacgcatcacagatttcctgtcctttcatgccggaaaccaaaccggaaaccagaccaatcagcacgaatatagcgccgatctccggcatgtcgtaaccccagaagaaaacgccgatgatcataaatacgaataaaacacctgcacttaagcctgcaagcttctgccggatggtcagaccggcgcttgccgcccctgtatccagctcacggcttttgtcaaggtcatatacggaactgagttcggggttgttttttacctttttggcataacgcatgacataaagaatcgcgatgcttgtcataacagtcagaacgatcaggcggtattgccacccggaatacagcggcagtccggcaattttttgtccgattcccactgtaaacggattggccagcgctgcggtaaatccggctgccgaaccgcaaagcgccacggcgcaggctgtgatcgagtcgaagcccagaaccaacatcaggggaagaatgatcgggacatacaccatacacaattcacacatgccgataaagcaatcaatgaccgcgaaggtaatcatcaaaatcggaatgatgatgatcccttttccggacagcttgcgggcaagcgctgagatggcgccgtgtataaaacctgtctttttcagcaccacaaatcctccgccaacgcagaaggtcaacgcgattacccagccggcctccacaaagcctgtggggatggctgtaaaaaattccataaaggccgttggatttcgctccactgtgtgaaaggaatctgccactaccaacattcttccgtcagcccccgctacacggtcgaactctcccgcaggaatgatataggtcaacactgccataagaagcatgatcccaagaagaatgataaaaatatgaggaattgtcaatttcttttttccggtctttgctctgctttcgatactcatccgtgacatattttcaactccaatctgatttttggattataagttcgctaccaatttcacataaaatgcacatgctttttccaggtgatccaacgggcaatattcattggcctcatggcacatattctccacgcccgcaccaaaaacgatggtgggaatcttgtgtttaccggcagaactcactccgttggttgttcctttgaagcggaaattctccacctcttcgttaaacagctcacggtaggcttccttcgcagccgttaccagcgcatggtcctcctctaaatcaaaggcaggcagcacggaatgcatcaccgcgtcatatccgttccatgtcttgtgttgaatgtctacaacctcccaggtggcgttcgttcccccaaccagcctgtccatctcttcaaactgcagcttgggcgttaaatggctggttgtccgcctgtctaagtaaatgctgcagctgtaaggcaccgcgttgagagaagcggaagcgctttcgattttagagagagcgatggttccgtttttccgttcctgggccagcagatcgtcgctcagcttcgccaccctgccaatgatttcctgcatctcatatacggcgtttacaccgtcctccggccggctgcaatgagtcgggattcccggcattgtcacgcggaacatggaacgtccgccgtgtccatggcaaaggcgcagatcggtggcttcgcagataacaactgcccgcggtttatatccgctgtttgtcaggatattgtccaacgccacaccgtccatgtcttcttccataacggaaaaactgacgacaatggttttgccctggtctaaatggagctccttcataatcgcggcggcatacaccataaccgctcccggcaccttcatatccgaagcgcccagtccgtaaagatttccgtttttcacctctgcgccaaagggatctacatcccacttactgatgtcgccctcgtgcaccgtgtcgatatgtccgtcaaaaaggatgacgtccggtccgtttccaattaccccaatcgcatttccgaattcatcaatgtaggcgttgtcatagttcagcttttccatttcttcgataacccgtttgacagcggtttcctcttcgaaggtataacttttgattctcagcaggtccttgcaaaaaatcaaaagctgctcgtttcgttcttcggtcctttttttgatcaaatggaccaaatccgttttttccattcccttcctcctgtaaaatttggacttacggacgtctctgggcacgtctgcccgttgattccgaatttttgtgatgatgttacggtcggttaccggtaattgacaaaaagatgtacactcagagtatagcaaatgccgcgaaacacgagaagcgcgtttttgccatagcggtcatgcagaatcctcataacccgacatgcagatttcagttgcaatgcggccgaaaaacaggtattgttacaatagcggagggataatacagatggatattcagaatctacgatatttggtaaagattgaacagatcggctccattaaccgggccgcccagtcgctgtatgtatcgcagtctactctgagccgcattctcaaggaggttgaggcccagaccggcatctctattttcaggcggactaacaagggcgtgatccccacaaacgatggggcgctgtttttgggcaaggtgaagaaggtgctggcggatatggaggagctggacagccagtttttcagctgccagaaaacagcggagatcaatcttttggttgcgacacagcgctgttctgtggtggtgagcgcgtttgtggattattataaccaaaattgcggggatgcgaagctgctgaatctggttctccaggaggaacctacggagaatatactgcgtctggttgcgaaccgtgtctgccatctgggagtccttcacacgaccaacgagcgggaggcggattttttgcaaatgtgccggaagctgggggtggagagccatcttttagacgaaagtcctgtgtgcgtccaggtgcgctgcggtcatccgctggccggacaggtcagcatagaccgcaaggcgctggatccgtatccccacgtgacgtattcggacgaggatatcacgaagatcaactattgctcagatatttttcaatacaaccagaatgtggtggaaaaacggattatcgtgcgggaacgtggaacgctgttgcaggtaatcgagggaacggacggttattatctgggctgcgattggagccgctacaatctcggggtgacgcagaagatacaatacatccccttaagtgacaccaatttgacgattaaaactttctggattcaacgggaaggctatgcgccggcgctgccggagcagtcctttatcgaattgttgcgacaatcttttcgcataccggatgaatcggtccatcagtaggaggaacacacgatgctatcatgcgacacccttgcggtaacagcgcggttttgcgcgcagggcagcaatactatggcaaaaaacagcgaccggcccctgggggaggcgcagccgctcatctggtttccgccgcaggatcacggggacggcgaaacggtggagtgcacctatatctccatccctcaggtcccccatacctacggcgttctgggatcgagaccgtactggatctggggatttgagatgggggtgaatgagcagggcgtggcgatcggaaacgaggctcagggaagcagggatgagagcggcgaaacacaaaccgggcttcttggaatggacctgctgcgtctgggactggaacggggggctaccgccagggaggcggtagaagttatcaccggcctgttggagcagtacgggcagcggggaaatgccagccggctgtttgagcggcggtatgaaaactcgtatatggtgatggaccccgatgaaatctgggtgctggagaccgcggggcgcaggtggatcgcacggcagattcgcacctacggggccattagcaactgttattccattgagcgggagttcgatttgtgcagcggcgacctggagcggcacgcccgggagaatggatggctgcccccgggagaacccttcgattttgccaaggcctacacgctgcccgcgtccaggcagaccaattccgtcacccggtggagacgtttgaaccagcttctggacggcggggagcctcagaatattccggggatcagaaggcttctgcgggatcactatgaggacggcctgttaaagcccaggtttggggcggcgtacggaacgtttcccaccatctgcatgcacgccatgacctgggatgcgtgccagaccaccgcgtccatgcaggtgttttaccgcgccggtctggggtctgtggcgcgccacgccatgtccctgccctgctgttccgtgtatctgccggtctatctgaccggatggcttccggcctgtatggagcagggtggggaacggtttgaggagacttccctgtggtggctgttcgagcggctggccgcggcggtcagcgcggattatgagcggtttgcgcctgcggtccaaggggaggcggcggagcttgaagcgcggcttgaccgggaggcggatcaggcggaagggcaggcggccgcactgttggagcggggggagaccgggcaggccggcgcggttttaaaccggatgatggagtccgccgcagaacgggcgcaagcatttgcacggcggcattttgaggccgtacgcggacagatggagcgggacggaggtgttttggggccgcggagggaatttttggaggattattgcgggagaacggggatggagttggtgtgagatcgcaggggctggcttaattggaaaactgcggacagggattgaaaagcagcggattttttagtacaatctggaataaatgcgtggagacgaggaactccgcccgggaactatgcgccggcggggttcttttttgtctgtgacagacatcggaagcggtttgagggcgattgctgtcggtccgtcggaaaaggggaggatttcgcaggcagagcaaaaatctgcagttttcactttaaaatacgcaaatactccgaaacgggatgtgatatgatagaaaaatgccgccggaccatggcggggagacaggaggaatgtgaaatgaagcattttatatataatctggaaccagaagggtatatcaaccgctttctgactgcgggcaccttctgccgtccgggggagtacgccagggcgactctgtccggcacggtgaacgaatggctggagaagggattttcggtctatgagaacccctgccgccgggagatgatcgggcagcggacgggcgcgctgccggagtatgtggatttgagcgggtacgggctgggggcggaggtggaggtgttcggctgccgcaaaccggtggagctgtacttccccttcggcaaccagggagtggatttctcggagttctatttcaatccgacctatctgcgcacttactgctataccgggcttttcgcgccggaggaggagtgggcggagtttgagcttcagacctgcgggggtctcaccctgtgggtcaacggacagcttgtggaggattttattccgtttacccgcaatatggtgaagcacaggcgggtgagcgcggcgctttgcaggggcatgaacaaaatcgtggtctgcctggaggatctggcggagcgggacacggattattatttccggctccggtatctgggggatcaaaaactcaaaatctgcatcccggccgaggacgaggtggatgtggacgaggtggaccggctggagggaatgttaaaggacatggcctttgaccgggaggtctatttgggcgggccggtggagctgtctctggaaaatccactggggcgccaggtggacattgaggctgtgtataagccggtggcggataagatcgcgcgcagcgagacgctggtgcgccgctcaaaataccgcctggccgccggggccggaagtctgagactgtttgacgcggagcgggagctgcccggattctactattttaccatcggctgccgggccggacgggtgtgggtgaagcggaaaattgccactcagatttttaaccgggagctgcttttggccggaccggataccctggaggggagaaagcggcgggctctgcaatatctggcggacactgaggtggataatgtatacaaggctgcggcgatcctggccaccggcggggactggaagcgggccgggagtatcattctggaggagctggcggggattgacgcgcgcaaggattgcagcgattttcacctgatcgtggtgttgcagatcgtgaagcggttcggagaactgctggaacctaacgtgcgggaggagatccggcgggtgatcctgaatttccgctactggatcgacgagccgggcaacgacgtgatgtggtttttcagcgagaaccacgcgctgctgttccacatctgccagtattacgcggggacgctgtacccggacgaggtgtttgcctgcagcgggcgcaccggacgcctgcagcgggagcgggcggaggaactgctggaggaatggttcggcacgtttttcggggagtatatcacggagtggaacagcaacgcttacataccggtggatgtgctggggttatgcggcctccacaacctggcggagaaggggagccgctggcatacggcagctgaaaaggcgttggatgtgattttccgggatctggcgctgctggcccaccggggggcggtgatgactaccttcgggagaagctacgagaaggagaacaagggcaattacgcggcgggcactacggcgttattgtacattgcatacaataaggggaacctgaaccgggcggccctggcgtacatttcctttgcgctgggggattaccggccccaggcggagaatgaggcgtttctggagacggcggagggagaggcgctggaataccggaaaacccagggctataaggggcatgtgaatctgtatctgtacaaggaccggtacgcccagctttccactgcggtgaatttccggccgttcacgccgggatatcaggagcatatcatgcaggccaccctggatatgacggcgcagatgtatgtgaaccatcccggggaggtgcagccctacggcaacggcaggcccaattattgggcggggaacggcacgctgccgttggcggcccagtaccggaatttggggatcatgatgtaccgcctggacccggagcacccggtggactttacccacgtttacgcgccgctgatggaattttcctcctatatcggcggggagtacacggtggcggcctgcaaggacggcgggtatgtgggcgcccgggcggtcaacgggctgagaatggaggagagcgggccgtgccggtaccgggagtttatgagtccggggcgggacaatctgtggattcttaagattggaaattgcagggagtatccctcgctggaagcattttatgagagcctggacggaatggaaattcattgggagccgggagtgagggccgaggtgagagatgcgcgtttggggcggatggttctgacgagggacgggtttacggtgaacggaagcagcccgtacgattacccggcgggtaacgccgggaggttgcggataaagcgcgtcggggcgccgggaaggcagcggcagacgctccttccgtccgccgcgcagagataaacaggaaaggcaggtaagatatgaaacacatgatggagaatacctgggacagggaatgggttcgggagaccgagaaacgggtgaacgcccgtatgatggatatgaagaataccggaatggaagaaaaatttccggtgagcctgatcgatatggactgttgggagtggccccagggcgtgggcctgtacgggatgtaccggaattatcagatggagaaggatccgcgggttttggagtttttgaccgcatggtttgaccggaagatcgcggaggggggaatggagcgaaatgtgaataccacggcccccatgctgacgctcacctacctgtacgagatcacggggaaggaaacgtaccggcggtttgtggaggactgggttcagtggatgatggatgaaacgggcctgctgcgcgccggggagggctgcttccagcacatgatcaccggtgatccgaacgacggtgagatcctgatcgacaccctgtttatggcggtgtttttcctggcccgggccggaaaaattctggggcgggaggagctcgtccgggaggcggattatcagattttaaaccacatccgttttctgctgaaccgggagacggggttgttctgccacggctggaatttccgggggaaccacaattacggcaaggtactgtgggggcgcgggaacgggtggtataccatggggatcatggaatatctggagcagatgggcaccggggatccgctgcggcgctatttcctcagcgtgtttgtctgccaggcccgggcgttaaaggagtatcaggattcagagaccgggctgtggcataccgtgatcgacaacccgcacacctatctggaaacgtcggccagcgctgcgttccttgcgggaatcatgaagggcgtccgcctgggatacctggaccgggaggagtttgagccggtgatccgccggggaatccccggggtgctggggaagatttcggaggacggcaccgtggagggcgtttcctacggcacgcccatcggctggaacgcggagttttacaatgagattgtctgctgcccgatcacctacggtcaggcgatgacgatcctgctgttgcaggagatacggcttctgtgagggatggaggaaaggcggcgggagatgagacaggaaggattttacgaggaattccactccttttactactacagcggcagtaccagaagttggaaaatgaaggggcttcatatccacaaggagtatgagctgctgctgtttatgagcgggggcgcttccatccggattgggagccggatgtatcagaccaggccgggggacctgtttttgatcaacaaccgggaataccataagaccgagggcgcggagggagcggcttacagccggtatgtgctgatgtttgatccggattggattttgggcctggaaccggctctgggctatcggttttcgcggctttttgaggaccgggaggagggcggcgtgagactgcatttgtccggcggcaccctggagcaggtgatccggcagatggagcgcatcgaggggtacagccgcaggcgggaggatgaggccggacaggttctcttaaagctctgtattctggaattgctggtgaaactggatgaattctcgcattcattggaagcggggggaggagacggctgggagaactgcgggagagccggatgggagaaggctggccgggagccgggaggcggcaggggccgggagccgggcagcggcgtgggccaagagccgggcagtggcatgagccggcaggcaggcagcggcatgagccgggagccgggcaccaccacccgggagcgcgtggagcagatcaaaacctacgtgcgcgaccatatcgacgagcgcctggatctggaggacatcgcgcggcagttttatatcagcagccattacctgagccactatttccggcgggagacagggtttaccctggggcagtttatcgcccaggccaagatcgaccgggccaaggagctgctgcaaaagggattttccgtgacggatacggccatttccctgtcttacaacagcgacagccattttatcaataccttcaagcgcctgaccggcaccacccctaagcgctatgcgtcggaaatgaggaagtgaccggatcccgccggaagtcagacggggagacgccgcagaatttgcggaacacccggttgaactgggaaaaactggtgaatccgcaggcggcggagatgtcggtgatcttttcacgggtgttgattaacgcgtactgggcgctgcggatgcgggtcatctggatgtaatggatcagagtgtagcccgtcacctgccggaaccggtgggacaggtagtaggtgctgatatagaactgctccgccagggattccagggataattcctcggaatagtggttgtggatgtagcttgtgatctggtaaattttctccgaaagcgggctctcgaatttttccggcacatagacgttaaagcttctcagctcccagagccggtagaggaaccgggtgaactccgcgtggaccatggtgtttaggatgtccgcgggcatggaccgggtggacaggagaaacacctggttgagcatatcgcttaagatcgccgttttttcctggtcaaagcggaagatggggatctcctggccgaagggttccagaatccgggaaaatgccgggtggctgtccagatactcctggggatagagaaagttaatgatcagccggcggctgggcgctccctgggggtagatggtcttgtggagcagggaggggcgcagcaggacgatgtctccggcgtgtatggagtaggggattccctccaccagatggctggcgctcttggccagcaggatatggatctcgtagaagctgtggaaatgctggaaatccatgtttacctggaaggagcgctcgtcgtagtcaaagtaataatagatgccgtcggacatgttgttgatgataatatcgtggcgcttttcatagagaattccgttgattaattcgctcatctgttcacctcaagggagtttcttctgcatgggatgcggtacatttcctcgattatacaacaaaaaaagcaaaaaatgcaatataattagcgatattaagcaaaaaagaagtagaatttggaggacaaaaaccgctatactaggtgcgtagtcgagagacggattgaaacatcggaggtacggcgtggaacacaggagagtcggggagctgcgggcggcagccggttttatgattttgatggcgggtctgggagtgagcgattccctgagagggattttcgccccggtgttccaacagcattttactctgaacgcctccggcctgtcggtgatcatcatggtcagctatctgggaaatctggtatttctcagcctgggcggacagatgatggaccggttcgaccggaagaaaaccaccatggcggtgctgcttctgtggatggcggcgttggcggtctatgtggtttccgatcactttctgctcctgctggtcagcgtgtttttcgccatgggcgcgtccacgctgttaaacacgacggtcaacctgctgacgccgcttatctttaccgcggctccggggatgttggtcaatgtgttcttcttcgtgcaaggagtgggaaccagtgccagccagaacctggtagggcggatggcggacagctacggcgtattccggggcgtgaacctgtttctgctggggctgggtcttctggcggcgctgtttctggcaggggtgaagatcccggaaagcggggagcgccccgcggcgacatcttccgcgcagtccgccaaaaaggcagtctccttcgcgaccgtaacgcggcagccgggcttctggctcctggtggtgatcttcggcttctactttgtggcggagcacggaatcatgaactggctggtggcttacggcaccggagccctgggcctcacggcctcacgggcggccctttacctgtccgggttctacggcggcatgaccgtgggacggctggtgttctcccccgcggtatccgctctgggagcggtgaggagcatctgcgggttcggcggaatcggagcggttctgtttatcctgggatcggtcctgggcggaagcgggctgtggcttttgagcctgtccggcctgttcctctccattgtgtacccaaccatggtgttcatgatcgggtccgttttcccgcagcacatgctttccacggcggcgggggcggtgatcagtctggggaccctggcggacatcgggtttaacctggtgttcgggagagcgacggactattttggctacggaatcagctttatggcggttcctctgtgcatggcgggcttttacctcgcatatctgaggtttgcgagaaggttcggggcgcggagcggacagattatatggaagaggggatgaacgacgatatgaaccaggaaacgatcaaagcagcgctgcggctgtacgcctccagtttcgagaaggtgctctatgaggaggatgaaacctttctcgaggggatgaagaaaaacagcctggcctgcgatgacatcaggcggtaccagttctgggaatggacccagggcgttggactcttcggttactggaagctgtttaaggccaccggcgaggagcggtatctgtcggttctgaacaaatattatgaacggcagtttgccatcggcctgccggcaaaaaatgtgaataccatgacgcccatgctgcctctgtcttttctggcggagcatctgggccgggaagattacctgaaggtctgcactcagtgggcggactggattatgacggatttccccagaaccgaggagggcgggcttcagcacatcacctcggacagcgtgaacaagggcgagctttgggacgacaccctgtttatgaccgtgctgtttctggccaatatgggccggattctggaccgaaaggactataaagaggaagcgcagtatcagttcctgctgcacaccaagtatctgtgcgaccgcgagacgggactgtggtaccacggctggacctttgaggagcggaacaatttcgccggcgccttttgggggcggggcaactgctggatcacggcggcgatcccggaatacttagagatcgcagactgcgacgagagcgtgcgccgctacctgacggaggctctgcgggctcaggcccgttccctggagaaataccaggcggaaaacgggatgtggcacaccctgatcgatgacccggattcctatgtggagtccagcgccacctgcgggttcgcctacgggctgctcaaaggggtccacatgggcctgttggatggtgcgtacgaggcggtggccttaaagccactggagcagattctggcttacacggatggggaggggattttacaacaggtctcctacggcacgcccatgggacgggaggacaagaacttttataaggaaattcccttaaagcccatgccctacggccaggcgctggccatgttgtattttttggaactggatcatcaatcaatgaaatgataagataaaaggaaagagaggaaggtaataatgaaaaaaacaagtaagatggcggctgccggagttctggcggcaatgatggctctgtctctggcggcctgcggcggcagctcgaattccggcgctccggctccggccgagacccaggcggacggctccgtaaagaccgagggcagaaccatgaaggtgttaaaccccgaggagccgggcgctgaggacgcgctgaacaaggccatggaggcctgggcggctgaggcgggggtaaccctggacaagatggtgatctcccacgacgaccagctgaccaagttcccctccatggctaagaacaaggacctgccggacctgatccagaccaccagactgcaccagctctaccccgaggagttcgtggacatgagcacggtggtggacaccagcctctttgaggagtccgcattaaagatcgtgggaaaggactacaagtccgacaagatttccggtctgcccagccagtttacgaccacaaacttctattataataaggacgcgtttgcggctgccggcgtggaagcccccacggtcgagaatccctggacctgggatgagctgtacgagaatgcggctaagatccaggcggctggaaacatcaagtacggctttgcggcggacgtttccagagccagatacgatattctgatgtatgccaacggcggctccctgacggtgaaggacggcgattccttcaaggtggcggtgaacagtcccgccaacgtgtccaccctggagcagtttgtgaaggccaacgaggacggcgtgatgcccaaggccatctgggccggcggttccacggacaacccggtggaatacttcaagaacggcgacgtggccatcctgctgtccggctcctggaactataactccatgaccaccgacattaccaagttcgagttcggcgttatgccttctcccaagggaaccgtttcccaggctgccatcatcggcggaagcgccctggcgatcccggagaacgcaaagaacaaggatctggcagaagaatttgtgaaatggttcttcgaggagggcaatttcaagaattatctccaggacgacaaggggctttccgcgttaaagaacgtggtgtacgagccgtcggatgagggtgctgccgcggattacaagattctccaggaggaagtgagctatgtgaccgacacctttatggtggacgaaagctccgcatggagaacctacaaggataacgagtaccgggattacatcaaacgcgcggtgagcggcgagctgtccgcaaaggatgcgctggattccttcgcaaaggagctgtctgaatcctcaggctggtccattgccgagtaagacaagctgtgccatagtttaaggaggatgatcaaatgggtaagaggaaacaggcgttttgccataccagggcgttctggatgtttgtcatgccggcgctgctgctgttttccgtatttttcatactgccgctgatccttagcatcggtttttccttcacggattacgacggctggaaaaccatgaactttacggggctgcagaactacacaaaattgttgtccagcggggagttctacaagacgctggggaggaccttcggctacgcactgttcagccttccgtttaaagtgatcgtcccccttttgatcgcggttctggctaccaccaaatactgcaagggcatcaccgtggtccgtaccatcagctatctgccggtgctgatctcggccctggtggtaggtatcaccatcaactggatgttcggccaggagtacggcctgatcaatttcatcatccagtccctgggcggggagccccttcagtgggcgttaaatcccatgcttgccacctttgtggtcagcttcgcctccaactgggcttccaccggattttacatgatcatgttcatcggaggcatcaacaacatttccaaggagctgtatgaggcttccagcgtggacggggcaaaggggtaccagaccttctttaagatcaccctgcccatgctcagccccaccattttcatcgtgctgcttttatccaccgtaaacctgttaaaggagtacgcgctggtacagggtatcacttccggcgggccgggaacctccaccacttatatcgtgcagtacatgtttaaccagggctttacccagtaccgctacggctacgcctccgcaatcggcgtggttgtgagtattgtgttcattatcattgcggcaatccagtttaaggctacgaagggaggagaaatcgaatgagtaaggcttccgataaaaagcgcgtgctgaccgtggtcaccaccattgtgggccttggcgtgtcctttgtgatggtatttcccattatctggctgctcatgagctcctttaaggactccacggagctgttcgcttacccccttcattttctgccggaaaacttcagtctggactcctacaaaaatgtgatcggcagcggatttttccagtatgtgaagaacagcctgtttctggctgtggtgggaaccctgatcaccctggctatcagcgccatgtgcgggtacggcctggccatctaccgccatgagattccctactccaacaaggtgttcgccgtgttcctgctgggaaccctgatccccggcgagattctgacggtctcccagttcaccgtgatcagcgccatcggcctgtacaacaacatctggggcgtgattctgccggtggtcaccaccaccacgggaattttcatgtaccgccagcacttcatgtccattccgctgtccctggcggagtcggccaggctggacggggccggggagttcaagattttcaccaccatcatgatgccgctggcatcgtcggtgaccgtttccctgaccattttctcctttgtgtggagatggaacgactatatcctgcctctgatggtgctgtccgaccagaagaaattcaccattcagatcgcaatcaagagctacatcggcaccatgggagtcaactggaacgcgattctggcgtcctccatcctctccattctgcccatcatcgtgattttcattttcctccagaagtacattaccgggggaatcgccaccacaggcgtgaaaggctgataaggaggacatcgtatgaaacgctatctggggcatctgatccgctctgcggagcgcagggtggagcatttcttaaacgcccaggttctggaccggtccagggaggacttcggagccatgcggggggacgtgatcgagggcaaacccacgatctacgccctggccgcggccgtctcggtgtactgtaaccgggacagccggtactaccatgacaaggatctgcttgaggccatgaacctggcaatggatttcatcggcagatggcagcgggacaacggtgcgctggattaccccacctgcaatttcaactctgcggccgacacctccttctgcttcaagcggctgttcgccgcctaccgcgtgctggagctgtacgagcccgcgggagcggacaaactggtggatacgctgcgggaaaaataccgctttgtcatgaggcgttccctggaaatgatccgcaccggaggatttcacacccccaaccaccgctggggcatcaccgcggccctgatgcagggtgcaggtttgtttccggacctggcgccggagcttatggcccgggccgggcagtatctggcggagggcatcgacgggagcgcggacggagagtacgcggagcggtccacgggcaattacaatgcggtggtcaacaatgccatgatggccatgtatgaggaatccggcgacccggactacctgggctacgtggccagaaaccttcatatgatgctgacctacattgacccggacggcaccattttcacccagaattccacccgccaggatcagggcaaggccgactatccggacaaatacttttaccagtacctgtttatggcctccctgccggaggagaaactgggagaatatggaaaatatcgcggggagttcgacgcggcggcccacaggatcatccgggacaatcaggagcggggcgacctggctccggactgcctgcacattgtcatggcccacaaggccatgtatgaacataagttttcgggctgcggcttcccggatacctaccggaaatatttccgggacgcgggggtgctcagggtcaaaaacgggcggtacggctacagcgtgctcagcggaaaatccgcgtttctgtacgtcaagttcggcgagctgccgctgtttgtgaagatcggcgagagcgtgggcagctgccgcaattttatcccggagaccatggaggtggaggatgggaaatgtaccctgaaatccacggtttacaccagctattaccagccctttggggaatcccagggcacaaacgactggtggaaaatggaccacaccaggcgggagattctaaacaacgcgcgcctggatatccaggtggagatcgccgaggcggcggacggactgagcctgcgcatcaaggcggaggggctctccagagttccgctccgggtgcagatttgcactccgaaggacgcggtgctggagcatgattgcttccacctgcgcacggatgcgggcggctggatgattttaaagagcggaatggcacagctgcgccagggcgaccggacggtggagttcggccccggcttcggtacccatgagttcggcgggcattacagcggcgaggaagtcaacgcttccggctacaccgtgtacttaaacgagtacactccatttgaaaaaacggtggatatccgccttgtagcggcgggaaaccgggacttgcagtgaggcgggacggaatatgaatcgaaaatgggacagaatccatacaattataaagacactgggggagctgcgctttaaagggcggctccgcccggagaccatcaggcgggcggacgcggcatatgatctgcccgctgtttttgaaccggaagcggaggcgtttgcggggctgaactgggagacggcgctccccggggacacatggggcggggcggaccggcatttctggttcgacacacaggtgaagctgccggcggactggcgtggggaaaaggttcttctctgcctgtccaccggggcgacggatctctggaacacggacaatccccaggtgatcgtgtaccgggacgggcagatgtacggcaccatggatttaaaccataaccggattttgctggcggagcgggcggcgggtggagagaccgtggacctgagcttttacgcctattccaattcggcgggcaggacgaacttcttcgacgtctccctgtgcgccctggaccgggagattgatcagctgtattatgatctcaaggtattgtgggacctggccgatcttatgggcgatgaggagaacgggcggctggagctggaggaggttctgaaccggtgcgtcaacctgctggatctgcgggatgtgagcggcccggcctttgcgcagtccgtaaaggcggcggaagcgtttttgcagaccgcgcactatagcgcagaacggccgctgccccgggtggtggttcacggcatcggccacactcacatcgacgtggcctggaaatggcctctgcgtcagacccggcagaaggcggtgcgcagcttcctcaccgtgatccggctgatggaggagtacccggagtaccgctttatgtccagccagccacagctctaccagtttgtgaaggaggaagcgccctggctctatgagaagattcgggagcgggtgcgggaaggacgctgggagaccgagggcgccatgtggctggaagcggactgcaacctgtcctccggggaatccctgatccggcacattctctacggaaaagccttttttcaggaggagttcggaaccggggacggccaggaggtgctttggctgccggacgtgttcggctactgcgtggcgctgccgcaaattttaaggcaggcggggatccggtatttcatgaccacaaagctgggctggaacgagtacaatcagatccccaacgacaccttttactggcgtggactggacggcagcgaggtgctgacctattttatcactaccagcgactacaaaaaatatccccaggtgggcggccgcaggtcctttgagaccacctacaacgggcggatgaacgccagccaggtcatggggacctggcagcgctaccggaacaaggatctgagccgggacgtgctgacctgcttcggttttggggacggagggggaggcaccacccgggagatgctggaggaggagaagcgcctggaggcgggggcagggaacttcacgggagactgcccggcggtccggatcacgggtgtaaaagaatttttccatattctggagaataatctggagggcaaaaaagttcccaggtggtgcggggagttgtatctggaattccaccggggcacttatacctccatggcccggatcaagaagaacaaccgggagtgcgagttcctgctcatggacgcggaactgctctgcgttatggcggggttggcggaccagggattttcctacccgcagcaggagcttaaggaggcgtggaagctgctgctgctcaaccagttccacgacattctgcccgggtcctccatcggggaggtctaccaggattcggaccggcagtttgcgaggctgcgggagatatgcgcgcaggtgacggagcgggcgaaacgggggattgccgcggcggggcatgatgagccggatggaaaatggttcgtggtaaaccagctgggatttgaccgcagcggtctggttgaaactgtggtaaacgggcaaaaacggctgcttttggtggaaaacgtgccggccaagggtgtgagggtcttgagtccgtcagactgggcagcgcgggaggaagcagaaggaaccggggtggttctcagctgggagcacggcgacggcggctttctcgccggtcttcgcaccgatttttatgatctgcgctttgacggggcgggagagatcatttccctgtatgaccgcagggaggagcgggagatcatcgccgccggtgggacgggcaacgcgttgatggtctttgaggaccggcctgagagctacgacgcctggaacatcgacgagtcctacgaggagaagcagtgggccgtcacggatgtgacccgtctggaactggtggaaaacacagcggtccgagcggtggtccgctgtgagaagcgctttatgagttccgcgatccgtcaggatatctgcttttaccgccacacggcccggatcgattttgtcaccaccgtggactggcgcgagagccagctgctgttaaaggcggcctttcccgtggacgtgctggcggagcgcgcggtttacgatgtgcagttcggaaacgtggagcgacccacccaccgcaacaccagctgggaacaggcgaagttcgaggtctgcgcccacaagtgggcggatttgtcggagtatggttacggcgtggcgctgctcaacaactgcaagtacggctatgacatccacgatggggtgatgcgtctgacgctgatcaaatccggcatatttccctaccccgacgcggatcaggagatccaccgcttcacctacgctctgtacccccacgccggagatttccgggccgggcgggtggtccgggaggcgtatgatctgaactgtccgctgattgggtggcagacggagcggaagcgggaaaacgggatggaggtatggggggacggtaaaaaagcagaagtggggtgcaggaactgcgaaacggcagcagcgcggcgcggggacggcgaaaacgcagccatgggccccggaagcggtagaaccacagccgcacttaccggcgcgcccctcaccggtttctccctcatccgcgtcagggcggaaaatgtgatcgtggagaccgtcaaacaggcggaggacggcgacgggatcgtgatccgcctgtacgaggcctacggaaaacggacccggaccgcggtggaggcctccatcctggcaggaaaacagctctgggcgtgcggctgcatggaaaaccggctgcgggagctgaagcacgacggagagcgtgcggagatcaccgtaaaaccctacgaaattctcaccctcaaaatctgttgatattgctgatattgaggcgctggttggcggaaacgacggcggcattttgatgataacaggaggacaacatggaatactatatcggaatcgacctgggaggcaccaatattgcggcggctctggtggaggaacagggaaaaatcctgggcagggccaaccttgccaccggggcgggccgtcctgcggcggagatcgcggcggacatggctcacgcgggccgcagagccgcagagcaggctggcgttcccatcgagcaggtgagcgccgtgggtatgggcgtgcccggcactgccaaccagaaggaaggggtgctggagttcgccaacaatctgggctttctccacgagcccattgtggagatgatggcgggctgttttccgggcaaaaagatctggtttgacaacgacgccaacgctgcggcctggggcgagtacctggcgggaggcggaaggggagccgattccatgatcgctgtgaccctgggcacaggcgtgggcggaggaatcatcctgggcgggaagctctggaacggcgtgaactacggcgccggggagctgggccatatggtgatcgaccggaacgggccggagtgtaactgcggacgcagaggctgcttcgaggccctggcctcggccacggctctgatcggccagacccgggaggctatggacagcgcgcccgggtctctgctgtgggagctctgcggaggagacaagcggatggcggacggcagaaccgtctttgaggcggccggacgcggagaccagactgcggccatggtggtggagcggtatatcggttatctggcaatcggcgtcaccaacctggtcaacatctttcagccggagatcatctgcatcggcggaggcgtcagccgggcgggggagctgctgctggagccgttgaaacggcttgtggcggaggaggattacgccagggacagcagcgtccacacggatatccgcctggcggagctgggaaacgacgcgggattgatcggggcggcgctgcttgggaggcgttgagcggctttcgcatggcgaaatcctgaaaccggacagaagaagcgtccaccgaatgaaaaccccatatttgaaaaaggaactctgttccggcaaaactgccggcagggttcctttttcgtttggatgcaaacggcttccggcacagcctgcggacgatggttggatggaaccagattgcccgccttatatggatattgtagctaaaattatgatattaatttgtcaataatgacggaattggcggcaaatacaaaaagattattgacaagcgaaacgtttcggtatatgatgaaaacagattttacagaaacgtttcgcctaaaggatgtgagggtataaaaatgcaggtaatttttcaagtggaaatgaaagacaatgtggctacggccctggcgccgctgacgcccggccccgcgcaggtgaagggggaccggaagacggactcggtttccgtgcttgagaatatccccatcggacataagattgctgtgaacgatataacgagcggggacgatattataaaatacggagccgtcattgggcgtgcgaccagggatataaaatgcggtcagtgggtgcatctgcactgtatgcgcagtatatacgacgagcggtcgagtcacctggatctctatacgggcgccccctgcgatattaaatatgaatgaggtggtaaatatgcgaacgtctgagcatacatggaacggctttaagcgcctggatgggagaatcggtatccggaataaattgctggtgatctatacggtggagtgttctcatttcgtggcggatgagattgtccggaggatgaactgcagcgaggtggaagtggtcggctttcagggatgtaccgacaatgagtatgcggttcggcttttgatcgcgctgatccgccaccccaacgtgggcgcggtgctcacagtcgggcttggctgcgagtatgtgcagcctgagtggctgtgcaggattgccagggaggagggaaagcccggagcgtggatgtttatccaaaatgagggcggtacggagaaagcgattgaaaaggggctgggttactgccgggacatgatggaacagttgaagcaggtaccggttgtccctatggggttttccgatctggtagtcggggcggaatgcggcggaagcgatttcacaagcgggcttgccgggaatgtggtggtgggcagattttttgaccggctggttgaccagggcggtaccgcgatttttgaggagatcgtggaggcggttgggctgctggacggccttctggacagagcggctactgacagggcccgggaagagatccgctacacctatcacaaggcccttgattactgcaaatccgtgcgccaatattccgtaagtccggggaattttgcaggcggtctttccacaatcgaggagaaaagcatgggcgctgtcgtaaaaagcggttcccgtcccattgaaggggttctgaaggtggggggaaggccgggacattcgggcctgtggctgctcgattccacgcctgatccccactggatgcagtttggcattacaaatccaaatgacaacgaggggttgacggatctgatctcctgcggctgccacctgacctttctggttacgggcgctgggaatgtggtggggagcgctgtggccccggtcatcaaaatcacgggcaacagcagcacctttctccgcatgaaggacgatatggattttgatgcgggcgctgttttgaggggagagtgttccctggacgaactggccgggcggctggccgggctggtcgggcgggtggccggcggcgagatgaccagaagcgaggcgctgggccacaaagaatactacataccttacaaatatcaggacaagaacgtgggggtcaaacgcgtttgcgatcaaatagaaggagaggtttaatgttatggtatttaccgatgagcagttaaaggatttctgtatgtccaggtgctattccctggacggccagacggcagttgtcacagggggatccaccggcctggggcttgccattaccaggtgccttgtgagcgccggcgcgaaggtagtggttttaagttatgaaagcgaggagcaggcttgcgcatcattaaaggaattcggtgacaaaaccgtattctatcagtttgatatcaccgatacggcgcacacccaggagatagccgggcgtatcctgcgggaacatggacccgtcggtattctggtcaataatgcggggaatcattgcaagaaatatatctgggacatgacggtggaagattacgtcaaggttctgaacgttcatctggtaggagcgttcgccctgacaaaggcgtttgtgccgcagatgaaggaacttggccgcgggcgcattctgtttcaggccagcatgaccagttatatcggccagccgatggtggcgggatacgcgaccgcaaaggcgggatatctggggctgatccatacgctgacggcagagctggcggagtttggcataacggtcaatgccatagcgcccgggtggattgacacgcccatgttccacaaggcggtggacaatgatccgccgcgccttgccaagatcatggggcgcataccggcaaagacagtgggagacccaatggacgtgggcatgtgcgccgcctttctctgcagcgatgcggcccgttacatcagcggcacatgtattccagtggacggcggcgcgctgatcggcttttgatcggaggactcatatggctatgtggaaaaatgatgaagagatgtttgcgctgatgaaggagaaattgtacaccccggttgtgggggatatcctggaccagatggggtataagcatcaattccttccggcgcagataaggcccctggccgctctggctccggcccaggcctacataaaaggggatggggaggacaaccggctgaagctggcgggctttgcctgtacgattttggagaacgatgtatttgaggagccgaaaaagcccttcggttacctgacggaggcgctggatcagttaaaaccaaatgaaatttacgtggccacaggcgctcaccattctgcgctgtggggagagcttctgaccacgacggcaaaggtcaggggcgctgcgggagctgttttagacggctacacgagggatacgccccaggtgatcggactcaatttcccggtattcgccagggcctgctgggcgcaggattccagcgtccggacatatgtctgtgattttcgatgcaccattgagatcggccaggtgacaatccgcgacggcgacgtggtgttcggcgatgtggacggcgtactggtgattccaagggaaatccatgagcaggttctggaaagggcttttgtcaaggcggcgggagaaaagaccgtgcgcgcggcgattgaaaacggtatgacagccacggaggcatttgcaaaatacggtattttataggggggataagcgagcgtgaggatcgagcgttttgagacgtggtgggtgcagaggggcgagaactttttcgacgaaaaacaccgcggcagatcaaagatggactgggacgtggtggtgattaagcttacggctgataacggcgcggaggggatcgccacggcaatggcggcccgttcggccagggtgacggagagctacctggaggataatattgcgccggtggttctgggcaggtccgcgtatgagcgggaggccatatggcaggatttgtggaatattgaccgcaatctgacttttttcccggtttaccttcccgggccggtggatgtggcgctttgggatatggctgcaaaggaggcgggacttccgctttacaagtacctgggggcttaccggaatcagctgccggtctacgccagcggcctgtttcacgataggccggaggaatatgtggaggaggccctgcggtacagggagcaggggatccgctgttacaaagcccatccgtcgggggtatggcgggaggatatcgcagttcataccgccctgagagacggcgtgggaaccaccatggatttgatgacggatccggttggggagtacacgctgggcgacgccatccgggtgggaaggaatctggaagacctggggtatctgtggtttgaggaacccttccgggattttgagatcaacaaatatacggaactctgcagcgccctggacattcccatactggcaactgagaccagcagggggtgtcactggggagccgcccagtccatcctcaaccgggcaaccgacctggtgagagccgatgtctcatggaaatgggggatcacggggacgcttaaaatcgcccacttggcggaaagcttcggcatgaactgcgagatgcatacgaccaccatgaactatatggatatggccacccttcatgtggcctgcgccgtgcggaacagcgagtggtttgagtattttgtcccggaggacaatttccgccttccgatgcaggggaatcttccgatccaaaacggaatcataaccgtttcggaccggccaggggtgggagttgagctggactgggagctgattcaacgcaaatgcgtatcctacagggatttacgcgcgtaagtaaaaaccgcctttacagggcggaaaaacatacatattttaaggagggtttacgatgaagaaaagagtaacggcattatgtttgacggcggcattggtttccggaatactggcaggctgcgggggaggagcggcgaagacaacggaggcgcccgcccagacgcaggcggagccggcgaaagaggaggggacgcaggctgagggagccaaggcggagacgcccgcggcagaactgccaaaggtaaatgttaaaatcggatatgagctgaatccgggcgaaccggccgaccttggcgccaacgccgtaaaaacagcgttggagtccgacgggacagccaactgggaggtggtcttatatccctccagccagctgggcaacaagtccaatctgattgatcagatgcttgcgggggattccgtggtcacggtggcggacggactgtacctcagcgattttgtgccggatttcagcattctgttcggaccgttcttgttcgacacatgggatgacgcctgggctacctttgagacagactggtttgagagcatcaacgcggagctggagacaaaggggcttaaggtcatcggggcggactggatttacggtgagcgctacacgatgagctccaaaccgatccatgtcccggatgatttcaaaggcacgaaaatcagggtaaacgcgttcccgatccagatcaagaccttctccaatatgggggcagctcccacacccatggccctgggcgacgtctatacagggctgcagcagggaaccatcgacggtcttgagaataccttcacaaccatgtacaataacaagttccatgaggtgtgtaagtatattgttcgggacggaatggtcaagaatatttcgctttggatttgcggagcggatttctataattctcttaccgcagagcagcaggaagcgttgatcaatgccatgcatgagggcgcgaaagccaacaatgaggctgtggagactacgtcggaagagtgcctcaagctgatgaaggaagcgggggttgaggtttatgaactctccgatgaggagctggctctctggaaggaagctacctccggcgtttacatggatcctgaagtgaacggaagctggagcactccggatctttacaatgtagtgagggccgcgatcggcaagtagccgttaccgtcacagacatgcacataattgtccggcgggtagttatgtgcatggactgtccaacaaggagaaggggtttcatgaaaacgaaactaaaggtcatatttttgaatttggatttggttttgacaagcgcggtgctgacggttctcgtgggcctgacctgtatcagcgtgttttcgcgctacatcttctttcgccccattgtgtggctggaggaagttcagctgtggtgtatggtatggctggtctatctgggggcgggagccgtctaccgcaacggtgggcatatcgccatcgagatactggtggaatcatttccaaagaaggtgcagaggattatcgccgcggcggttaatgtgctcatggtattcatactgctgttccttatggtccagggaggacggttggtggggcagatgctgaacaccggacgggctaccagctacacaaaggtgccctatgctttgatctattcggcggttccggtgggatgctttctcatgatctgcaacatgctggcggaactatatcaattatggaaaggcggctctgacgaagacaccgcggaccgcgaaagggggcaagacgtatgagctcaggaacaatcataggattttcgtgcatcgcgctcttgattctcctcttcctcaaggttcccgtttacggggcaatccttggcagcaccattatttatttcgtgctgcagccggacgttaccatctacctgattattcagaggatgatcgccgggatcgagagcatcccgcttctggccgtgccgttttttatcgcggcgggcgtatttatgaattatacgggcgtcactaagcggatcatggatttctgtacggtgctgacctgtaaactgccgggtggtctggcgcaggtgaatgtgctgctgtcgacgatgatggggggcctgtcgggttcttccctggcggatgccgccatggaggccaagatgctggagccggagatggaacgccatggatacagcaagccgttttcttcggcggtgacggcattttcatcgatcatcacgcccctaatccccccgggaatcgcggcgattctgtacggttcaatcgccaatctgtccatcgggaagctgtttatcgcggggatcggtcctggtttgctgttgtgtacatcgatgatgttactctgcgggattatctctaaaaagcgcggctaccaggcgtacggacaggccaggatggacaggaaggagctgggcacgaaatttcgccacgcaattctgccgctctgcctgccggttatcattataggaggcatccggctgggcatctgcacgcccacggaggcggggtccatcgcggtggtttactccattatcctgggggttctctaccgggagctgggctggggcgagctgaaaaaagggctcagggagagcgtgcttaccacggcttccgtgctgattatcgtgtcggcggcatcggcgttttcctggattttgaccagagagcagattccccagaagctgacggccctgatgaccacctatatcggcggaaaatacgcgtttctggtgattgtcaatgtattccttctgtttgtgggaatgttcatcgagggaaacgcggcgctgatcgtgctggtaccgctgctccatcccatggcggttgcctttggcgtggatccgatccagtttgcgctgatcttcaatttcaacatggcgataggcgcggtaactccgcctatgggaacgcttatgtttactgtctgcggcatcaccaagtgcaagatgaaagattttatcgtagcgggcctgccattttacgcgctggcgctgggctgcctggcgttgctgacctttgtgccggtatttacgctgggaattgtcaatttagtattctaggagaaccgagggaaacaacatgtttatcaattttccggaaattaacgaccttatgatccaggacagggaagtcacgatccccaaaatggttaccatacggcagcatttcgacacctatcagattgccgacataccccttcatatcagggaacagatggaggcgaacgcgggagcgcctgagcgttttaaaggcaagcgcatcgctatcactgcgggcagcaggggaattcccgatattgtggtaatcctcagagctatctgcgatatcctgaaggaatggggggccaagccctttgtcgtgcctgccatgggaagccacggaggcgccaccgccaagggacaggaggaggttctggcctcctatggaattactgaggcaggaatcggagcgcccatcagatcctccatggacgtggtgcagtacggaacgctgcccaatgggattccgctgttctgcgacaagctagcgtttgagtcggacggtatcgtgatctgccacaagataaaaccgcatacggattttcgaaatgagcatgagagcggcctgtgcaaaatgatcgcaatcggattgggcaagcacaagggggccgcagccatccactcacagggattttgcgggttcggaagttttattacggaagcggcccggcagtttttgcaggcggctcccgtggcgttcggtgtaggaatgatccagaacgcatacgatgagatccatacgctggaggtgattccgggagcgcagatcatggaggcagacgcgcgcctgttaaaggcagccaagcagcagctggccggttttaagtttgacgatatcgacgtgttgatcatcgaccggatcggtaagaatatcagcggctatggctttgaccccaatgtggtggggcgctcgaacagccggtgttatggttttgaggacccggtccgaatcaagcgattgtttataagagggctgacgccggagagccatcacaatggcagcggaatcaacgaggcggatattaccacccggcgctgtttaaatgacatagactggtcggagacatggaccaatctgatcaccgccactgagatacagggctccaaaataccgatgtacgtcaacaatgacaaggaagccctgaccatagccctgcgctgctgcaacggcgcgcccagaccgcacagggtggcgcgaatcaaagacacgctgtccatgaaggaactgcaggtgtcggaggcgctgtatgaggcgatcagggatcagccggacattgaatatgtgagaggtccggaagaaatcctgtttgacggggaaggttttatggcggattgagcctcgtttccggccggtttgcggcgggcggttgtcattgacgcggggggttttatgagttaaacttaaaaaaaatcgaaaggtctgaactcgtgaaaaccagaaccactattaaggatatcgctgccagggcgggcgtatcattgtcgacagtccatgcctccctgaataacaaaccgggtgtgggtgaacaaaccagaaaccgcatctgtgagatcgcaaaagagcttgactaccattcaaacacggtcgcagcttccctgaaacggaagccttactgtattgcggcgctttttccccaggagacaggggaataccgctattattatgcggatatttggaagggctttcgcgattatatgaaaacgctggcggatttcagcataaaggcggttgagattccgtacagagatgagccggatcaccggtatattgaggaaaaacttgaccagctgtccgctgaaggccagatcgacggaatcatttccgtcgggtattcgtcctccggaatcgtgccgcctgtgggtaaatattcggaggcggggattcccgtggcgctggtgggaaatgacaatgaaaaaatcaaccggctgtgctgtgttcaaacccattaccggatccttggagagattcttggggagatactgacgagcaggcttggggacgaggacgaggtgctcttgtgcatcggaaacgagacggttccctcccatttcctcattgtagaggggttcgactcctacattcaaaaatatggaatcaaaaacaggatcatacggatcccgggttacgacagcgtaacctatgagaagatatgcgagcagttccataacaattacaacattaaatcctgttccagcgttacagcgcgggggagtatctttctgggcaaagccatcgagagctgcggtcgaaaaggcagcgtgcttgccgtgggaagcgatctgttcccggaaaatatgtgctgcctggagcaggggattttctcaaatctgcttcataagaatacttaccgccaggcatatgtggcgactcagtatctcacggaatatctgctgagaaatattgctcccccgtcggagaatgtctatgtcagaagtgaggtgctgtttcgaagcagtattcctatgtatcagtgcgaggctgcgtcgggaaatcatttatatatatcctgacagacaggaggtacaacggatgaaggcgatcaggattaacgcacccggagaggtggaattgatcgagatggaaaagcccgtgcctaaaaaaggcgaggcgcttttaaagttactttatggggggatctgcggcggagatttaaatacataccggggcacgctggcgtatgtgtcctatccgcgtattcccggacatgagttctcggcggaaatagtggaggtcggagaaaatgaatacggcttgaaagcggggatgatcgtgaccgcgaatccgtattttaactgcggaaaatgctattcatgccggagagggcttgtaaactgttgcacgggcaacgagacgatgggcgtccagagagaaggggcctttgcgcagtatatcaccatgccggtggagcggatttatgacggaaagggactggatcccaagctgttggcgctggtggagcccttctgcatcagctatcacggggtgaagagagccgccgttaagcgcggcgagaaggttttggtggtaggggccggaaccatcggagtgttcgcggccgtggccgccaaggcggcgggagcccaggtctatatttcggatgtggcggaggataagctggaatacgcaaaaaattttggagtggacggcgccatattaaatgaatccgcagaggtccttgaacgggcggtgaacgatataacagacggggacgggtttgacgtgaccatagaggccgtgggattgccggatacatttcagaactgtattgattccgcctgttttggcgggcgtgtggtacagatcggaatcgggaagaaaaacgcagatttcaattttaccatgatacagaagaaggaactcaatattctgggatcgcgcaatgcttttaaggatgattttattgaattaatcgaactcatccggagcaaaaacgcggatgttgggaaggccataacggacctttataaatttgaagacgcagcccgggcgtttgaggattttaaaaatcatccaggcaaaagcctgaaggtgatgctggatttcacctgacggccggttccggtacaaagacggatatccggcggctgatttgcagaaatacagaagccgctgaatatccgtcttggcaaccgccattctttgtgttatattaaagaaacaccgggaaccggagcgtgtgccaaatgcctgtctgccggattcacaacgttctaatgtcatatgcttcattcagtttgccgcgggcgatcaaaccgcgcggcagtcgacaatccagtccgtttcggacgaacgatcagtttaacgacaatctgtagtacaatacataaggttgattgaaatatcgcgggggccggttgcctggtgccggaatagttgttataattataatgtagacaggtgtttgcacatagctttgcgggacaaggaggctgtggtcacttacgtgatctgctcctcccgggtggcggaaccggtcaccgagctggcggaggggatcaatgtttaccgggtgcgcgtgatccggatgagaggccgggacggggacaaggtattcgcgggtctggaggagaagcgcagaaatggcgggaaggtgcagagggcggagctggtgccactgcttctgacgccgctgatgtccagccgtctgagcgtgagagagcggattgtgaagagcctggaaatccttcaggaggaagaggcggcggtgaccggcctggagatggaaaaaatgcaggcggtgctgtacacgtttgcggataagttcttatccgccggggatctggaacaggtaaaggagatgattgcgatgacgagacttggtcaaatgttggttgaggacgggattgcccgtgggatcgaacagggaatcgaacaggggatcgccctcacaaagcgggtgctccgcctgtcggcgaaggggttcacgcgggatcagattgccgaggactgcgggatcgggcggaaggaggtagacgacattctgcgcgaggaagaggacctttgacccccttttaattttggcagacggtatgggaaggagcgatccagcggcatgcaggcctttgtgaggactgcgtgccgccgttttgccgcgtgatggcgggaaaaatgtaaaggcagattgcggtcattgattttgttgtcgataaattgaccaaagtgagggggaaatgccagaaaaaccgcgcgggaaaatactatttgacgctgtatggaaaagcaagtataatgatggaagtaagtttttgggagcggtgaacgcagatggttggactaaaaattgaggatgtaaagggttttaccagcaagctttttgtaaaagaagactttgatttgtttctggtaaaggaggtacagattgtcaccttcaacagcttttccatcgacggacatatccggaagggatatttttccgaggaggagctggaagagatcggagatgagggatttgcgccctggaagctgctgcggcctgtgtgtttcggcctgatcaagggaaagcggctgccggggagttttcacatcgtgctccagctgccggccggtcaggtggagcgctttgcgtccggaaacggcgtggaggccggacagattcagggcatgtatctgaatattcggtacgaggatggagcactctattgtataaccgggctgtccctgggcttttttacgctggacaagaccctggaggatttgtgggaccggtccgcggaagaatttctgcgcaagcggggaatcgcctgcctgcgggaatagcataccctgaccgggtcagtgtcgatccgtccgggataaggagcggagattaaagccgcgggctgcggcctgcggatgatttttacgtgcggggatgatgagatggcaaaattatactatcgttacggcgcgatgggcagttccaagacggccaacgcgctgatggtggaatacaactacggcgagcggggcaagcgggctctgttggtgaaacccaggctggacagccgggacggggatcacatgatccggtcgcggatcggcctggagcgcgagggcgttctgttagaagagctgacacagatgagcgacgtccggctgcgggaatacgactgcattattttggatgaggctcagttcgcaaccaaggaacaggtggaatttctggtccacattgtggacgatctggacattccggtgatctgttacgggctgcggaccgatttccgccacgagttttttgagggcagcaagtggctgatggcctgggcggacaaggttgaggagctgaaaaccgtctgctggtgcggaagggcggccaactgtactgcgcggatcggcgaggatggccggatggtgcggatcggggaccaggtagtcatgggcggcgacgaccgctatgtggcgctctgccggaaacactacaaccagggcgacctggggccaggtcttaaggaaccggtgacggcggacacaggcggtttggacctgttttgacagcaactatggaggcagcggacagcgcggttataaaagcgcacacggaaaggacggcggtgtatggacaaaaaggtactggcggagaagctggggattcttcaggacatggcggcaaaacaggagaacttcctggaattgaccgcagtgctggactgtctgcgggatgtccaggtgacaccggaggaattggaagaagtttacagccgtctggagcggaagggaatccgtgtgggaaccccggagggggacgctgagctggagccggagctggatttggaggacgattttgacaccgggctggacgcgggtgttttaggcaaggacaagcttctgaccggggacgaggagacggaggacggtctggttctgcgggagaagccgtcggaatacgccgaggccgaggaggacctgttcagcgaggaagcgccccagaaggtgttggagggcgtgagcaccggtgatcccatccgggaatatctgaaagagatcggcgccatcgcgctgctgactcccgaggaggaagccggacttgccaagcgctgcgcggagggggatgaggaggctggaaaacgcctggtggaagccaatctccggctggtggtctccatcgccaagcgctacaccggccgggggatgagctttctggacctggttcaggagggcaacatcggcctgatgaaggcggtggaaaaattcgactatgagaagggataccgtctgagcacctacgccacctggtgggtgaagcaggccatcaccagagccctggcggaccaggcgcggacgatccggcttcccgtgcacatggtggaggcggtgaacaagatccgccgtacccagcgtgacctgtccgtgcagctgggcagggacccgtccaaccgggagctggccgaggcggttggaatgaccgagaagcgggtggaagagctgattcagacttccggcgacacggtgtccttagagaccccggtgggagatgaggacggctccagcctgggagatttcgtggccgacaacgcgggcgactccacagaggatcaggcggagaacgtgctgctgagggaggagatcgacagtatgttacaggggctcaacgagcgggagcgccaggtaatcaagctgcgcttcggcctggagaacggccggcctctgaccctggaggaagtgggaagacaatttaacgtcaccagggagcgcatccgccagatcgagacggcggcgctgcggaaactgcgcaatcccgtgcggagcaagaaggtcagggattttctgccttagagaaaagggggattcattgaagataatcaatcaggaatccgcaaagagcgttccggtttcggtgctgcctctgcgggaaatcgctgggtttccggtgcgtccgggtctgtatgatatgaacggcgccacccttttgcaggacggcgtgaattttacggtgcacacccactcgggaaccgcatgcgagctgctgctgtttaatcggggggagaaggatccctacgccgtgcttccgttcccggaggagtacaaaatcggcaacgtgtactccatgatcgtgtttggcctggatatcggggaattcgagtacgcttaccgggtggacggacccaatgatcccggagcgggactgctgtttgaccgggaccagattcttctggatccctacgccaaggccgtgaccggacagagcgtctggggtgaaaagcaggagccgggctgtacataccgggccagggtggtgaagaataatttcgactggggagacatgccgcagtccggccgggagatgagcgacctggtgatctatgagcttcacgtgcggggctttacccgccacagctcctccggtgtggctaattccggcacctttgcagggattttggaaaaaattccctatttaaaagacctgggggtcaacgcggtggagctgatgcccgtgtttgagttcgacgagaccatgggcggccgggaggtgaacggccgcaagctgctggactactgggggtacaacacggttggatttttcgcgcccaacaccagctacaccgccgggctggagtacaatcgggaggggacggagttcaagaacctgatccgcactctgcacgagaacggcatcgaggtgatcctggacgtggtgttcaaccacaccgccgagggcaatgaaaaggggccggtgatctcctttaaaggttttgacaacaacatttactacatgctgacgcccgacgggtattactacaacttcagcggctgcggcaacacgctcaactgcaatcaccccatcgtgcagcagatgattgtggaatgcctgcgctactggaccgtggactaccgggtggacggcttccgatttgatctggccagcattctggggcggaacgaggacggctctcccatgaacaatccgcccctgctgcagcgcctggcctttgaccccattctgggcaatgtaaagctgatcgccgaggcctgggatgcgggcggcctctaccaggtgggaacctttccggcctggaagcgctgggccgagtggaacggtaaataccgggataccctgcgggagttcttaaagggcggaacctgggcggccggggaggctgccaggcggatcaccggctccggagatctctacaacggccattatgctggctacaattcctcggtgaattttatcacctgccacgacggcttcaccctctacgacctgtacgcctacaatgaaaagcacaatcaggagaacggctgggggaataccgacggggcagacgacaaccgcagctggaactgcggtgcggaggggccgacggacgacaaagaggtgctggatctgcgtttccgcatgatgcgcaacgcctgcgcggtgctgatgtgcagccgcggcacgcccatgttttttgccggggacgagttcggcaacacgcagcttggcaacaacaacgcctattgccaggacaacgagatttcctggctcaactgggaactgctcaaggaaaatgaggacctgttcggttttttccgctttatgatccgcttccgtatgaaccatccggccatccggagggatctgcccggcgcggtctgcggtctgcctgccctgaccgtgtacggaaacggtggggagaaccgggtggacgacggcaccgccgctctggggattctctacgccggatacgaccggaagcggggacgggacgacgtggtttacctggccgtcaacgtctactgggaggacgtgaacattcagttgccggagctgcctaagtatctggactggtatgcggttgtgaacaccgcaggggacggggagagccgcttctgctaccgctgcggagagcgcagcagggtggactccggttttcggatgcggccccgttccgtggccgtgttcacggtgaacggcaaccagtgacagcaggaaacggtgttgaattatacttattagcactcattttgattgagtgctaattttttgttgactttttcattggatggtactaaaatgtagaataaagggttccgggagtggaatctctgacaagaacgaaaagaaagaggcgtataagatatggctaagaaaggcagtttatccattaccagtgagaacatatttccggtgatcaaaaagtggctgtattccgaccacgatattttctaccgcgagttggtcagcaacggctgcgatgcaatcaccaagctgaaaaagctggagctgatcggagagtacgagagaccggaggatatggattacaagattcaggtttccgtcaaccccaatgaaaagaccatcaaggtcacggacaacggcctgggtatgaccgaggacgaaatcgacaaatacatcaaccagattgcattttccggtgtccaggatttcctggaaaaatacaaggacaaggccaacgaggatcagatcatcggccactttggcctgggcttctactccgcgtttatggtggctgacaaggtgaccatcgacaccctgtcctatcagaaggacgcaaagcccgtgcactgggagtccgagggcggcatcaactttgagatggccgagggcgacaaggagcaggtgggaaccaccatcaccctgtatctgaacgaggacagccacgaattctgcaacgagtaccgggccagggaagttctggacaaatactgcgcgttcatgcccgtgccgattttcctggataacgagaccgctgagccgcagtatgagaccattgagaaggacgagctgacggacaaggacaccatcgtggagaccgtggtggagccggccaaaaccgaggaaaaggagaatgaggacggcaccaaggagacggtggaggtggagccctcccgggagaagtacaagattttaaagcgcccggtggcgttgaacgacgtgagcccgctgtggaacaagcaccccaacgagtgcaccgcagaggattacaaggcgttttaccgcaaggtgtttatggattacaaggagcccctgttctggatccatttgaacatggactatcccttcaacttaaagggcatcctgtatttccccaagatcaacatggagtacgacagcctggaaggcaccatcaagctgtacaacaaccaggtgtttatcgcggacaacatcaaagaggtgattccggagttcctgatgctgctcaagggcgtgatcgactgcccggatctgccgctcaacgtgtccagaagcgcgctgcagaacgacggctttgtgaagaagatttccgactacatcaccaagaaggtggcggacaagctgtccggcatgtgcaagacggaccgtgaaaattatgaaaaatattgggatgatattgcgcctttcatcaaattcgggtatattaaggatgagaaatttgcagagaagatgggagattatatcctgttcaagaatctggacggcaagtatctgacctttacggactgcctggaggagaataaggagaagcacgagaacacgattttctacgtgaccaacgagaaggagcagagccagtatatcaacctgttccgccaggagggaatcgacgcggtgctgcttccccacaacatcgacagcccctttatcagccacatggagcagaagcacgagggcgtgaaattcctgcgcatcgacacggacttaaacgccgccttcaaggaggaagtgaaggaggacgacgaggagttcaagaagagctccgaggagctgacggagctgttcaagaaagccctgtccaacgacaagctggacatcaaggtggagaagatgaagaacgagggcgtggcctccatgatcacggtcagcgaggaaacccgccggatgcaggatatgatgaaaatgtacaacatgggcggcatggatccgtcgatgttcggcggcaccggggaaacgctggtattaaacgccaaccatccgctggtcaagtacgttttgaaccataaggagaatcagaacacggacaagatctgcgagcagctctacgatctggccagcttaagccatggcccgctctcgccggagcgcatgacgaagttcgtgtcccgcagcaatgagatcatgctgatcatggcgggcgagaaggcggaataattccctgaagctgcagttccctgaataacgtaggaggatttacggggatgaaagaagagtacaaaaacgataagttcctggtggcgatggatgcggccggagccgatgtggacggcgcgctgaaccggtttatggggaaggtttcgctgtacaagaagtttatgaaaaaatttcttgaggacaggtcctatcccgatatgctggaaagtctcgccggtcacgatccggaggaggcgttccgccaggcccacacgctcaaaggcgtggccggcaatctgggaatcaataatctgctggccgtgctggtccccatggtggaggtgctgcgcgccggcaaagaaccctccgaagaacaggtgagtgcctgcaaggtggagtacgggaagattgtggatattatcgagcgcgattggagcgaatgacaaggtgcggtgccgcgaaagcggcgccgcatttttggatgcagtgagctgggggaattgcaccggcgcgcggcctgcatttaaggacagggaaccgcatatactgatagggaatcccggaaatgaggacgcggaggaacgcgatgcaatatttggaaatttattttaaaaatatggaagagatggtggattttgtgcgccgggcaaacacagtggaggcggacgttgacctgcagttcgggcacattctggtggacgcaaagtccatccagggcgtgctggctatgggctgcggctgccacgccaaagccgtggtccactcccaggacccggaggatctggagcggctgaaagccaaagcgtgagaaaagaaacccaaatccaacccagggtccgcttgacatctggacctatcatgatataataagtagtaatgaatactacatgtgatatagacatgttaaaaaagtggagggatccttgccggaagacaaggatgcttcgggtttggaggaagcttaatatgacctacaaaatcatcggggacagctgcctggatctgacggaggagatgaagcgggattcccgttttcagatggttccgctgacgctccaggtggggagcgcccaggtagtggatgacgagacatttgaccagaaaaaattcctggggttggtgaaggcctgtccggagtgtcccaagacggcatgcccgtcgccggagacctacaaggaggcctatgagcaggcggaggcggaagcggtgttcgtcatcactctgtccggccatttaagcggttccaacaattcggctgtcctggccaagcggctcttcgaggaggagcgtgcggagaagcagattacggacaacaagcgggtggaggtgatcgactccctctccgcgtccgcaggggagctgaatatcgctctctttatccagggactctgcgaggccgggctggagttcgacgaggtggtgaagcgggccctggagttccgggaccggatgcacacatattttgtattggagacgctggacaccctgcgcaagaacggccgtctctccggcctgcaggcattttttgccacggcgttaaacatcaagcccgtgatgggagcggacaagggtaccatcatcaagctggatcaggcccgtgggatcaacaagggactgcagcggatgtgcgatatcgcggttcaggaagcgggcgacagcgcggataaggtggctgtgatcgcccactgcaacaacgcccagcgggcggattatgtgaaggcggagctcgcaaagcgggcgaagttcaaagcgattgtgatcacagagaccgcaggcgttgcgacggtgtacgccggggacggcgggatcgtgctggcggtctgacggccggcgatccggtggtttgcgccggacggtttgtgccggagcgcattgtaaatcaaacgattgggattaaaattgtgccaaaccgcggacaatatgcggcttggcacaatggcgttttaatggtatgattagcttactgtttgcaggacctggtgttcggacggtctgtgaacgggaaacgggcgggaatatcagggctgctgccggagccggttaaagccggtacggcggctttttcagacgaacaggaacgtgacagaggtggacagatgaacaggacaggatgggctgccgcgctggcggcagtgctggggattgcgcttgccggcgtgatcggttatatggtgtggcacagcgccggacattcctaccaggcggtggggacgcaaaccgctgcgggggaggccgaaagcggcggaagcggcgggcaggaaggcgcaaacggagcgcccggcggtgagaacgaggcgtttgggaataccggttttggcggaggtggggatagcgcggttgacgggggcggcatcgaggggaatgaaaccggagacagcggttcctttgggcacggggatccggcagaggcggcggagtccgaaacggctgaacccgaggatgataccgtgcgcctggtgttcggcggagacgtgctgctctcggaccatgtgctcaacgcttacagcaagactggggatatcaccggcgtgctggacgacgggctgcgggaggttattgcaggcagcgacctgtttatggtcaaccaggaattccccttcagcagccgggggactgcggcggcggacaaacagtacaccttccgtctgccgccggaaaaggtatccattttgaatgaaatgggcgtggacatcgtgacgctggccaacaaccacgctctggatttcggaaccgatgcgctggtggacactctggataccctggacggggcggggatcccccatgtgggcgcggggcggaatctggatgaggccaaggaaccggtgatcctcacggccaagggcaggagcattgggtttctgggcgcttcccgggtgattcccgagggctcctggaacgcctcgtccaccagaccgggcatgctgaccacctacgatcctgcggctctggtggaacagatcaaggctctccgggagcgctgtgattatctggtcgtctatgtgcattgggggattgagcgggatgagcgcccccaggactaccaacgattcctggggcagcagtacattgacgcgggggcggatctggtgatcggcgctcaccctcacgtgctccagggccttgagtattacaagggaaaacccattgtgtacagcctgggcaacctggtgttcggcagcagtattcccagaaccgccctgctggaagcggactgggacggcgagaacaccactctgcgcctggtgcctgccacctcgtcggcgggctacacccggatggtgacggacgaggccaagaagcaggaattttaccagtatatgacggatatctcctacggcgttaccgtcacggagcaggggatcagcgcacagtaaggcggcccgtgtaatggcccattggctgcgccggaggtccatcgtatccggtaatcgcccgcagctgcgccggcatcgggtcacatccaattcaaaaagcctggaaagtgttttgctttccaggcttttaccgtctcatgaaatcattcagctctgtccggtctgattataacgcagttccagaaactggttataattcttctggtacagattgtccagatccttggagtacccggcgatggccctggggcagtagctggataatgcctggatcacctcgtcggcctgctgttcgttcttgaccgtgatctcccgctgcttgtggtccgcgaaggagatgttgacgccgtaggtctttccggtgggaatcccgttgtagcggtggctggtgattcgcttgtacatccacaccacgtggtccggcagatccaggtagtagcctgcgccgcctaccagcataaacaggaagttccggtcgatctgaaggccgtgaagctcctgggtgtgggagaggaaatcgcgcacgcgctcctcagagcgggaatcaggcgcggattttaagaacttccggaccgcccgctcatagccggtcaggctgttgtagagaaagaacattccaaggccggtcgccgcaacgccgatggcgaacagaccccacatggtgccgttatccatcccggcgacctcgccgatctccacatagtagggcagaatgctttccttcacctcatcgtccagctgataccagtcaaaaaattcgtggtaatactgcaggctcttgctggacagcggctggatggtgccggtgatctcaaactgataaggctccagcgcgtccgagtcgatcttgccgtccaggtaatcgaaggaggcttccatcagcgcgtccgccttctttaagtcgccgctgcgggctttcagggagatgtagtggtaatctccggcgtcgatcacgtactcccgggctttgacggagttcgtcttggaggagacggtctccgagtaagcgccgtaaatcccgtaaaccgtggtgcgcacgtatgttccctcgatttctccgctgtagtccagctcgtccagcgtcacgggctggctgaacgcccttgtaaacagggatttcccggaattgcccagcataaaaattccaattcccaaaaagagcacgatcaaaaaccaacttgactttaaacctttgtactttgacatacagatccccctcatccccggcagctgcggggcggattccgccgtgaaccgccagcttttacaaaattttaacatctacctgtatttaaccacatccccccgcttatgtcaaacgccttatctgataaattccatcttttccctggaaattcccgggaaagtaaagcgtagacaacggcccacaggctacgccggcaggccgttgcattcaaagtaaaccgtttaaaacctcacgaacaactttccttcccgctccctctgggccgcttcctccagaatggcctttgtggaacgggttccgatccgcaccgtgccggtggccagtaccgccagcgcctggtccagcgtcttcacgccgccggcggatttgaccataatatgcgggctaaccgacgcgcgcatgatctttaaatcctcgattttagagccggagggcgcgtacccggtggacgtcttcacaaaatccacccccgccttctccgcgatgcggcaggcgtgcgcaatctgctctccggtcagatagtggttctcaaaaatgaccttcaacagcgcgccgcgctcgtgggctgctgccgcaacccttgccagctcatcctgtacatagtcgaactctccggacagaaatcgggcgtagttcatcaccacgtccacctccaccgcgcccttttcgatggcgtcaatggtctcaaaaaccttggactccgcggtggcggtgccgtgggggaaggcggccacagtggtgaccagcacgccgctgtccctaagctcccgggccacgatgggcaggtccgaggggcgcacgcacacggaaacgcagtggtattcctttgccagggcgcagccctccaccagctctgcggtggtgatgtccggcctcagcagggagtggtcgatggtgcccgcgatctccctcacggtgatggaatccccgtcatgaaatatttttacatttgataatcccatagcgcacctcctttagtacgggttgaaatcgccctcggccatctgcttcatgtcgaataccttctgcaggaattccatctcgcaggaaccgtcgaatttggttgcgtttgcgaaccagggcgtggccttctcctcccagatctgattggcgtgggtttcgcccagtttcttcatgtaggcatcgatatcgtcggtcttgacgatgaggatggaataattcttccacatgtacacgatgcactcctcggccccggcttccttcaaagcgtccagctggcctttatagagctcgctggaggggcagttcatgtgcatgtcgatgtagtcctgcacgtgttccggtttcagttcattgatcatcacatagcgttttcccatagtattattctccttcttctaaaagttcttcgatcggcgacccgtcgcaggtggtcatctcaaatccaagcaggcgggccaatgtgggcgcctggtcgatgatgcggccctggggcaggtccaccttacgcctggaataggggttgtagaggaaataggtgggctgcacgcccttgtagggctcgtggccgtgggtggcgatgctggagcggtagctggcgttgttggtgtcctgcaccagctcggcgttgaaatccgaggagaaggaggcgttgccgaaggattccagcacatagtcgaaatcgccgtccagatggtacttctccttcacctcctcacgggtgtagaatttttcaatgttcagctccccggcgtgctcctctaacagggagatcaccttccccgcaacctcggggtcgtggttcttaatatagagatggccggacagggagcaggtgtggaagtatgcggtccagtctgcaagcccgccgttttcgtccacggtgatgaagccgtggtcccgcaggaaacggttgatggagtacactctgcggatgtccagatggccgtggtcgctggtcacgttgatgatggtgcggttttccagaccctggccctttaacgcctttaagatgcgggcgaagcccttgtccagatactcgtagccggtccaaagctccttgctgaacacgccgtagttgtgccgcaggtaatcgatgcagaccaggtgaaggtacatcacgtccggctggtatttgccgatcaggtactcggcggtgtcaaagcagagctcgtcgcccttgtaatatttatgcagcttgaaggagtctttgatgtaggggtatacctcgtcaaagaatcccggcttggagcgctggcggatgatctcctgctcattttccggaatcacgtggatgcctgcccggtggatattccactccgcgtcgtcccccagggtcaggggccagtagacctcggccgcggtgtagccgtgttttctggcttcctggatcagggtgggcactttcacgtccgtggccttctcaaaccattcgggttccatgttgccgggatcgaagtgttcgttgccgatcacgccgtgggttccgggatagcagcccgtgctgatggaggtgtggatagagtgggtgtagctggggtaggtggtgagattgcgcctgataatagaggagcgttccagcagcttccccatgtgcggcatttggcggatgatctctaaatcctccgtcaccattgagtcgatggagattacaatcaattttctcttttccataatgcatcgcctttctgaatatagaatataaacttctggtttacctgcggaaaattcacacattaattttcatatatttttcatattattgatgaaattcagaaaaaatcatgtgaaaaatttctgcacggttcttactgtggagtatagcataaagaaccaggcagttcaagaggacaaactgcattttaaataaactttgaataaatttacgaataatatgaaaattttcttgtgcgtatttcactataaaataataaaaagatgaggcactttgtgtattgaaaaatttcacatgagaaaatataatgaaaacacaagcgaaaaagcatggtaaaatatatgaaaattttcacaaataagactgtacaaatacgcaatgatttgatatacctgtctcatataacaacttttgtgttcattaacaggaaaggaagacagaaatgacgttaaaagaaatttcagagaaaaccggattttcgatcacaacgatttccagggtgatgaaccggaccggttatgtgaacgaggagacctaccggaaggtcatgcaggccgctgaggaaggcggatattttcagaagaaaaagaacaccgtgctgaacaacaacattgtgggcgtgattgtgccggacctgtccaatccatttttcggggcagtgatcagagggatcaaagaggtgacggagaccatgcacaaggaagtggtggtcatggacaccagcgaggatttcaatcaggagaagcgggcgctggccctgatgcagagcatgaagctgtgcggcctgatcattacccccatatccgactgcggacagggcggttatgagatcgaaaagatgctgacggacttaaacgtgcccgtggtcctggtggaccgggatgtgaagaactccgcgtttgacggcgtgttcatcaacaacacccagggcgcctttgagatcacgtcctatttgatccagaagggatacgcgcggatcgcgattatcagcggccccaggtactccaagccaggcagagagcggcttaaggggtacaagaacgctctggaaaaatatgggattactccggatgaaaagttgttctttgagggtgatttcagcttggagagcggatatgccctggctgagaaaatgctgttgcagggagaccttccccaggcggtgttctgctgcaacaacctgatgaccatgggctgcgtcaaggccctggccgcccacaaggtgaagatcggcaaggacatccaggtggcgggttttgacaagctggagctgatcgaccaggtgatggatttaaagatcgccacggtggaccggcccacggttgagatggggcgggcggcggcggagattctgctgcagaagcccaagcttccggagagcagtgtgatccgctccggaatccgaatggatttgatgcccaaattgagcgtatacgaatagaagagaaaggaagagacgacgtgagcagagtgatggtgttgggaagctttgtggtggatctgatggccaggtccccgcattttccggaaaaaggggaaacggtaaagagcagcttttttaagatgggaccaggaggaaagggattcaaccaggcggtggccgccggccgggcaggagcagatttgcgcgccgccatcaagctgggacgggatgaattcgcccaggtggccttaaactggatggaacgggacgggatggacaaatccaatgtctgtttcagcgagacggttccgacgggggcggcgctcatcatggtggacgacagcacggggcagaacatgatttccgtgtttctgggcgccagcgacgactttaaccaggcagaccttgagcggctgtacccggagattgaggcctgcgactatcttctgcttcagctggagatcaaccagtgggcgctggagcgggtgatcgcctttgcaagggaaaagggcgtgaaggtcatcctgaacccggcccccgcggcaaagctcccggaagaactgtttaacggtctgttcgcgatcattcccaacgaggtggaggccaggctgatcaccgggattccggtgaaggaggcgggctgcgaggaggccgccaggtggtttttcgaccggggcgtgcagaacgtggtcatcacattgggcggagacggagtgtacgtaaacgacggcgttaagagccgcagagtgccggtttacgcctccaccaaagcggtggacaccaccggcgcgggcgacgcgttctgcggcggattcctggcggctttgggagaaggcagggatgtgtttgaggctgtggagttcggaaacgtggtgggcaacctggccgtgcggaaaatcggaacttccccggccatgcccacgagagaggaaatcgatgcatttttaaattcggaggagggccgcaggtaagcgggacgaggccggagcttaagcgatagaaaacggaggggtaatcatgggatcaattaaactggaacacatcaataaaacctacggaaaagacgtgatcattccggatctgaacctggagatcgaggatgggtccttcaccgtactggtaggaccgtcgggctgtggaaagtccaccacgctgcgcatgatcgcaggtcttgaaacgcccagctcgggccgcattttcatcgacgacacggatatcggcgtgctgccgcccggcaaacgcgatatcgccatggtattccagaattacgccctgtatccgaccatgacggtccgccagaacatcgaattcggactggaaaacaagaagattcccaaggaggagcgcaggaagctggtggaggagatcagcgagaccgtgggcctgacgccctatctggaccggaagccgtccaagctctccggcggccagagacagcgtgtggcgctggcccgggccatggtgaaaaagcccaaggtattcctgatggacgagccgctgtccaacctggacgccaagctgaggacccagatgcgcgtggagctgatccagatgcacgagcgcttaaaaaccaccttcgtctacgtgacccacgaccaggtggaggccatgtccatgggcgataacattatcctgatggacaagggcatcatcatgcagcgcagcgctcccacggaaatgtaccagaacccgcagaacgtctacacggcccggttcattggaacgcctcccatgaacattctgcagaatgccctgccggacggttaccagctgggcttcaggccggagcgcgtgctgtttgaacgccccgagggggagccggctttccggatgaacgtgcacgtggtgaccaaggagaacttaggatccgagtgcatttactccatgacctgcgatttcggcgccatcagcgtgaagtcccaggacgatgtgatggagcgggacgtgacggtctatgtgaaatacagcaacctttacatattcgacgcggagtccaaccgggcgccccttgacgagaccgtcaggcggcaggtggaggagatcagcgcacgcgtgagagaggggcggtgatcagatggctaagacaaaggagaaattccacgatccaaaccagcagaaattcgccaatatcaaagggttttccctggtcgctccggcggtgtttctgatctcgctgtttacggtctaccccatcattttcaccctttactgggccttccactccggcaacctgatctcgccggacagcaagtacgtgggcatgaacaatttccgctatctgttctccacgcccagcttcctgaaagtgctgatgaacacggtgttttacagcgtgatcgtggtggtgctgacgatcgcggtggccacgcttttggccgtatggctcaacggcaagcttcacaagaaatttaacggatttgtgcaggcggtgatttttacgccccacatcatctccctggtgtccgtttccatggtgtttttgtggctgttcgactcccaggtgggctttttgaactccatcatcaccgccatcggatttaaggcgtttccatttttcaccagcccaagaactgcgttgttttccctggttctggtcatggtgtggaagcaggccggatattacaccctgttgatcatggcggcgctccagggggtgccccaggagatttacgaggcggcctccatcgacgacgcgccggcctacaagacatttttcagaatcaccctgccgatgatttcgcccacgctgtttttcgtgtccatcacagccacgatctcatccttccagatatttgacgcggtgaacctgattaccggcggaggtccgctcaactccaccaacacgctggtgtactatatttacgagcagacctacaagttcggcaagctgggtaccggaagcgctgccagcctgctgcttctgatcctggtgggcgttctcacgttcctgtatttcaaggtgctggagaaacgggttcattatcaatagagggaggttaagttatgaataacggggcaaaaaatatcgtcacccgggtgatcgacctggtcatgaaatgccttctggtggtgatcatggtatttcccttttactggatggtgattacggcgtttaagacgcagaaggaatccatgatctttccgcccacgctgattcccagccagatcacctttgagagcttcagcacggtgatggaaaagattcctttcggcctgttcttcaagaactcgctgatcatcgcgctgagcgtggtgctgctgcagtttatcgtggtggtgcccgcggcctacggctttgccaaatacaatttccggtgcaagaatctgttcttcgcatttgtccttctgggcttcatgctcccgcagcagattacctttgcgccgtcctatctgatgtttaacaaagtggggctgttaaacagctacgcccccatgatcattcccttcattggaaatgcctttggcatattcctgctgcggcagtatttcctgcagataccccaggagatcattgaggccgccaggctggacgacgccagcgagtggaagatcattgtgcggatcatgattccgatggcccgcacggccatctcctccatcggccttctgagtttcatctcttcctggaactcctatttctggccgttggtcatgaccagcaacaatacctaccgtacgcttcccatcggagtcacgcttctgaccggttccgagggagccagccagtggcccatcgtgatggcgggcaacctgatgatggtgcttccgatcctggtggtttacggctttgccagcggcaagatccgcaaggcgtttgtttactcgggaataaagtaagtttcatatatcattttaaaagaggaggatttctaatgaaaaagaggactttaagggcagcggcgatgatgatgacggcggccatgtgtgccgggatgctggccggctgcggcggcggaaaggctgagactgcggcacccacgccggctccggcggcgggaggcgagaccacccaggcggcagcgggggatactgctgcggcagatacgggcgcagcaggcggcgagggccgaatccaggtttccttctgggagggcttaaagggctcccatctggagaacatcgagaagattgtgaacgattacaacaattctcaggacaaggtgtgggtgaccgtgtcctaccagggcgactacaacgagactgcggctcaggcccagaccgctctggcggcgggcaaccagcccaacttatgccagctggaggtttccagaatcaaacccttcttcaacaccggaaaggttctggatttgaagcctttcgctgagaaggacggattagacctgggctccttctacgaaggtctgatgagcttctcctacgatgagagcggcgccctggcttccctgccatttaaccgttccacctatatcatgtactacaacaaggacatgtttaaggaagtgggacttgaccccgaagctccgcccaccacatgggctgagttaaaggacgcggccacgaagctgtccatcgacggcaagcgctggggattctccatcccggcggacggcatgttcttagagagcctggtgttccagtgcggcggcacctccttaaacgaggacggcacggacatcggtttcaataacgaggcgggcatcgaggccatcgatttcttaaagggcatgatgaacgacggcctgatgaaaaccccggcgggcgaggactacaccagctttgactcctgcagaaacgatttcatcggcgggaccgtgggcatcatctactcctcctccggcgacatcaactatctgaccgagagcactgaatttgaactgggcgttgccatgcttcccgccaataccgagcagggcgttggcagcggcggcgcgaacatcgtgatgtttgacggcttctccgacgaggagaacgcggcgacctgggatttcgtgaaatatctctgcgatccggaggttgcgggcaagttcgcttccctgaccggatatctgcccaccagccccgcggctgcagagagcaccgcgtttaaggagatcattgccaagaacccggcctaccaggttccctgcgatatgttaaactatgtaaaagagcgtccgtatcacccctactacaccgagtattactatgacgttctgaacgacgccatcagccagatcctgctggatccgtcctacaccggtgaggttgcggtaaaagacatttccaaccgcgccaagcttctgctgaaccagtaaagattgcagatttgattgccaaagcggcagctgtacagcggctgccgctgttttttaaaccattttgaatgaaattgggctgccgcggcccacccgtttgagggaaaggagacgaaatgctgaaaaaaggaatattaaacccaaatatcgcccgcctgctggcggagaccggccacaaggacgccattgtggtcagcgacgccgggctgcccatgccgttgggcgtggagcgcatcgatctggcctggaaggaaaatgaacccggctacattccggtgctcacggagattctggagcacattgtggtggagaaggctattctggcggaggagcttaagaccgtcagcccggccatgcacgaggagattttaaagacgctgccccagggagttccggtggaatatgtgccgcacgtggagttaaaggaacagacgaagcaggcccggggcatcatccgcaccggagagtttacgccctatcccagcgtgatcctggtggcgggctgcgcgtattagcctatggagcgctacgcgctgttcgactgggacggcacgctgcgggaggggtacacgctgtttgagtggatcggttttttgcgggaacggggggaaatcctctccgcccgggtactgaagcgtcacgaccgtctggtggcggattacagggacggacggatatcccacgacgtgctggcgcgggagagctgccaaaactatgaggagggaatccgggggacccgggtagagcgctacgaggcgctgcgaagcgagtaccaccgctatgaccgcacccggcagctggcctttgccccggcattgtttcgctggttgaaggacaggggaatacagcccattgtgattaccggcgcgccggtggatatgatcgaagcgtatttcggggagtacggaatcggggaggcctacggacaccggttggagatgcgggacgggcggctcaccggaaacgccctggaaaactgcggtttccacaaggagcgcaaggtccgggagctggcggagcgatttggctgtccgccgatgttggcggccggggattcggactccgacctgcctctgctcctggcggcgaaaacagccctggtggtcggagggcgggcggagacattggcccgggttcccggcggaaagagtgttcccagggagattgagggagtaacgttaatacaaaatctggaaaattggataggagaatgtgaagcgatatgagcaatgaagagatgttggcaaaagtggaccacacactgttgaaaccctatgcaacctgggcggacatccgtcagatctgcgaggacgccatcgcctaccacaccgccacagtctgtattccgcccagctacatcggccggattcgggaagcttacggcgatcgggtaaagatctgtacggtgatcggtttccccctgggataccaggtgacggaggtgaaggccctggaggcgaaaaaggcactggaggacggcgccagcgagatcgatatggtgatcaacatcggggacgccaagggcggacggttcgacgcgattacggaagagatccgcaccttaaaaaaagcggtgggagatcacgtgctgaaggtgatcattgagacctgttacctgacggaggaggagaagattaagctctgccactgcgtgacggaagcgggggcagacttcatcaagacctccaccggcttcggcagcgcgggggccaatctggaggatgtaaagctgcttcgcgccaatgtgggcccccaggtgaaggtgaaggcggcgggcggaatccgcagcatcgccgacatggaggacttcataaacgccggggcggaccggttgggaaccagctcggcgattaagctgatcaagggggagaatacttccgggtattaaggtgcagcggaaacattctgcagtcccgttttttggagggcgggctgaggagcagggatgaaacttaaccgcgacgggagaaggaaatggaagaactgttaatttgggaagaaattacggaactgagggaactcaacagcctgtctgtgtttgtgcgcctgatgctctccatgacgctgggaggcgtgctgggggtggagcgggagcagaagcgcaggcccgcgggcttccgcacctatgtgatcgtctgcctgggctccaccctggtaatgatgaccaatcagtatgcccacctctacatgggggcgccggatcccacccgcatcgcggcccaggtggtcagcggcatcggatttttgggagcgggcaccattctggtcactaaaaacaatcaggtaaggggcctgaccacggcggcagggctgtgggctgccgcggcgctggggcttgccgtgggctgcggattttacagcggcgcgattatgggatttctggcgattctgatttccatcaaggtgctccacaccgtggattatctcatataccgcaaatcgccggtcgtctccctgtacgcggaggtggatgacatcaagagcgtcagctgccttctcagttacgcgcgggagcacgggatggccctgggagatctggagatcaccaagcagaagcagatgaacggcggagggatctgtatccgcgggacgatccgaatggagcagagaaaaccccacgatgtgatcatccaggagttcgggcagctgcccggggtcagttatgtggaggagctgcggtaaggcggtgaggtgcgttcggctgggcggagcggccgggcagccgggaaggcagcccggaccggcgaatacgcgcggtacggccggattcagccggataaacgcccctgccaggtattccgctccttaaagcgcctggccagcgtgtttaacaccaaccgtttgttgccgctccatgagggcgcgatgagcagggacttgggtccgtcgccggtgaggcggtggatcaccagctcagggggcagaagctcggcgcagtcaatgacaaaattaatgtattcctccatggaaaagatgggaaagggatggttctggtaataatccgccaggtccgtcccttttagcacgtgcagaagctgcagcttgatgccgtcgatgagcccggcccgggagaattccgccatgcgggttatggtttcaagcatccgttcccgatcctcgcccggcaggccgagaatcacgtgaaccaccacggtgatgccggccgccttcaggcggcggcaggcatcctcaaacacgggaaagccgtacccgcgccggatgaaccgggcggtgtcctcgtgtacggtctgaagtcccagctccacccacaccggtttcctgcggttcaaaccggccagcagggagacggtctcatcggggaggcagtccggcctggtggctacggagagcagggcgacgtccgggtgggagacggcccgctcaaagaggctgcgcagccgggggagaggggcgtaggtgcctgtgtaagactggaagtaggcgatgtaggagggggcagagggcgccatggcgctgctttcggggggcattttccggcgcacacgggccttggcggcctcgatctgctcccacacgtccgggcaggcttgggcggcaaaatccccggaaccgccgctgctgcaaaaaatgcatccccggtttcccaaagtaccgtcccggttgggacaggtcatgcctccgtccagagacagcttgtagatcttgcgcccgaaccggcgtttcagctcatagtccagggagtgatagggtttctggttccagtccatgtttgacctcctgcagtttggcccggcggggcagggctttgaaattgattatagcagaaaatgcaggggaggcaaatccggactgataaattttgctatatattaagaaaatattctattgaagcccggcaagcggctgtgttaaaatggtcacaatgaggacagggagcctgcccgaaaattttacataaaaggagaggcaagtcatgaatgtgaaggaaacgatccgtctgatggagagcgaaccggccggtaagcttttgggggcgctttacggaaaagaagcggttgaggaacaggtgaagcgctatcaggaacttctggcaggatttgagaagaccttcggggagtacaaggatgtaaagcttttctcctcgccggggcgcacggagatcagcggcaaccacacggaccacaaccacggcaaggttctggccggcagcattaacctggattgtgtgggcgcggctgctaagaacaactccagccaggtgcgcatcgtcagcgagacctacaaccaggactttaccattgacttaaatcagctggagcccagccccaaactggcgggcaccgtggacctggtcaagggcctgttaaagggatttgaggagtccggctatacggtgggcggcttcaacgcgtacatcacaagcaacgtgatcagcgccgcgggcgtcagctcctccgcctcctttgagatgcttctctgctccattctgaatacctttttcaacgagggccgcatggacaccgtggcctacgctcacatcggaaagtttgcggagaacaaatactgggccaaggcttccgggctgctggaccagatggcctgcgcggtaggcggtctgatcaccatcgacttcttagagccctcggatccggtggtggagaagattgactttgactttggatcccagaaccacagtctgatcatcgtgcagacgggcaagggccacgcggatctcagcgcggattattcctctgttcccaacgagatgaagaaggtggcgcaattcttcggcaaagaggtgctggcccaggtcagcgaggccgaggtgctggaacacatcgccgagatccgggagttcgccggagaccggtccgtgctgcgggccctgcatttctttgaggagaacaaacgggtggaggccgaggtggcggcgttaaaggagaaccggtttgaagatttcctgaccaacatcaccgcttccgggaattcctcctggaaatggctgcagaactgctacaccaccgccagccttcaggagcagggcatcacggtggctctggctctgaccgagctgtttatcgcggataaacagcggggcgcctgccgggttcacggcggcggatttgcgggtgtgatcatggccatgctgcccaacgatctggtggacgagtatatttcctgtatcgagaaggccacgggcaagggtagcgcctaccggatgagcatccggccttacggagcggtctgcgtgagtgaattaatataatatttacataatatttatgcgctattggctggtaaagcaccgataaacgcagtataataacgctatatgggatgtaccggatgtgaccaatgtcttggggcgaagacgtgaacggggaccactggaaaggagaccatatggacagagaaatactggagcgcatgaaaaccatggtggaggagagctgctatacggtggcgctctgcggttccggcatgatggaggaagtgggcttgaaggggttaaagcgggaggacagggcttacgagattgaggagaaatatggagcctccccggaggagctcttcaatattgcctgttactccaggcacccggagcggttcttccagttctacagggaggagatactgaagcaggaaatgcagatttccccagcagtgtacgagctggcggccatggagcgggccggaaagctgcagtgcctggtgaccatcaacctgcacgacgcccccataaaggccggggtcaaacatgcgatctgtctccacggcagcgtgtaccacaaccgctgcccgcgctgcggcaggcagtacggcgtggattatatgataaactccgtacccgtgccgctgtgccaggactgtcatgcggttatccgtcccggcgtctccctgttcggcgagatggtggacagccacagcatgagccgcaccgcccaggagatatcccgtgccgacctgctgcttttgctgggcacctccctgcggtccgacgtctacagccagtacatccgctattttaagggaagcagtttgattatgatccaccgccttccaaggcccctggatgagaaggcggatctggtggtctacgacatgccgcagaacgtgctccctggtctgggatatctggagcgggagaggaacaggcagctcctgaaaagcaggctgcgggtattggagaacccagaggtccaaaacgggtagatggaacagatcgatcggaaaatgagtaaatgggaaaagccgtcgggctgccgtgaaacatggcggaccggcggctttttgtcgcagtggcggcggttggagtttgcagcccattgcatttttggagcgcatatgttaagctttttaacagggaaaattttacataccggtgaaaagccggcaaaggaggttaacatatgccagtcggcgtactgatcaacaccgccgccatttttctgggcggcatcgtgggggccctggtgggcggacgcatcccacagcggatcaacgacgctcttaccggagtgttcgggctttccgccatcaccatgggcatttacctgatcatccagctctcggccctgtcggcggtggtcatgtccattattctgggaactttgatcggggagtgctttaatatcgagcacggcctgagccgcgggctctcccgcctggcttccagactgccaggggactcgctgtccgaggaacagctggacaacattatcagcatgatcatcctgttctgcttcagcgggacgggcctgttcggagccatgaactccggcctttccggggatcactctatcctgatttccaaggcgatcatggatttctttaccgctatcatattcggggccaccagcggttatctggtgggggtgatcgctgtgccgcagatgtgtatcggcacgctgttgtttttcctgggcagcctgctcatgccgctgctgaaccaacagatggtcagcgatttcaaagcggtggggggaatcattaccctggcggtgggactgaaaatcgccaagatccgctatttccgcgtgatcaacatggtaccggcgctggtgttggtgttctttatctcgcggtggtggctgacgctgccggtctgagcggatttgaaacttggagggagtttatggatcgtaaagaaattatggaggagttacaatcgcgggcttctgaaaaatataaagccaatgttgtgagaatgggaataccggaggaacattgtataggcgtgtcaacgggtgaggttcgggcgattgcaaaaaaagtcggaaagtgcaatgaactggcgtttgaattgtggaacacgggttatcatgaggcaaaattgctggcggttcttgtatttgacaagaagcacatcacgcacgccgatattgaaaaactaatggatgaggtggtgtcatgggatttgtgcgatcatctgtgtaaaaatctgatcgccaaaatgaatgactacgaggagtttatcgataaatggagcaaatcgactcatacttacaaaaaacgtgctgcctacacgctcatcgccacagcagctgttcacaacaaaaagctttccgacgacgctctggacgggtatttggaacgaatcaagcgcgattcagatattgaacaggatcaagtaaaaaaagccgtgtcctgggcgctaagagaaattggaaagagagattttagcttcaacgaaaaggctcttttaacagctcatgaaatgttgcatggcggaaataaagcgcagatttgggttgcgaaagatgccattaaagagttggagaatttggtgcaagtggaaggccgggctcgtttgatttcggcgaaaacgcaaatgggagcaggagggtgtgattctgttgaataaagcaggatgtgcgaagggagagggaatggaaccgttgatgtacatgatgatgattgagaagagtaagacctataataagttaacaaagaaaatcgtaatagaacatgttgaaaatataagaaaactggatgacgaggggaaattggaaatttgcggtgtgtttaaaggttatccggggatggccggtatgtatattctgaaaacaaatagccgggaagaagcggaagaaatttgcagaatggagcctttggtattgggaggatatgcgacgtacaaattagtcaccttacaaatcgcaaaccgggaaaataactatttgttataaacatatgtaaggtaattaagggaaataaaaaatcggatggaaacccgacttttgaatcagaaaaaggaaagcctgtgaaagggagcatatgtggtaaaaccggctacaggagcagtcatggtatttaaattagacgtaaattattcagaggaagaactgaaatttatcagagagcataattgcagtattcttgatgagataaaattgtcaaaaacagacttttcaggaaatgaatatccgcggcgcgtgtttcagtatggcagcgcctatattgcagaaattctggaaggaacgatgaatcttagagcagaggagctgctgcccttttcctataaggcagaggattaaaaatggtagggggtgctgctccggtagatcaatcatctaccggagcagcagctccttttcagcgcaataaaacagaattttgcgacacgctctatttatttgataaagagttgaggagcaaacaaaataagatatccagtggcatcgaatggtcgacccggctgaatgtaaaagttctgccgggtttattttgactgttatataactaaatttccccgggccatcgattggcccggggaatttgagaatgatccggcataaatatcaggttttacttcgctgcctccgaaaactgcgtcgtcaccaaatcttcatagggtacccgctggggcagctctccggcttcctccaggatgttctgcagcagctcgaagctttctttctcaaagatggtgtcgtccttccaggtatcctgggatttgtagcggtccacgatgatggtcagcttatccaggggcgtctcctggaactggggctggatggtctttgcgatctcctcggcggagtgggagttgacgtaatccatgcctttttggatcgcatttgtaaatttttgaataatctccggattcttctccatataactcttcttcgcgcagtaagccgtgtagggcacatagccggattccgtgccaagggaggctaccacgtagccgctgccgtccatttccaggccggtggcaaagggctcgaattccacggtgtagtccgcgtcgttgctggtgaaggcggcggcggtcaggccgaagttgatgctctggtcgatgtttagatccgtcttggggtccaggccgtgctttttcaggatatactcgaataccatctggggcatcccccccgctctccctccaagcaccttcttgcccttcaggctgttccagtcaaagttggcttccggctggcggcctaccaggaagttgccggcccgctgggtcagctgggcgaagttgaccgcgtaatcctcgttgccgttggcgtaagtatagatgctggcctcggagcccataaaaccgatgtccgcatcgccggaaatcatggcggtcatcactttatccgcgccggctccgttgaccagcgtcagatcgatgccctcatcctcaaagtaacccagctcgatcgccgcgtactggggcgcatagaatatggaatgggccacttcgtttaaggtcacaggggtgagcccgccggcggcctccttttttccacagccggtcaggctgagggcggccagggagcctgccagaaaaacagtgagcagtcgtctcataatcgtctccttaataatcatagtctcatagtaccattgtattgcgggacggggcggagtgtgaacgggttgggaaatgttttcccattgccgggtctgggaaataatggtatgataaatgggatgaagctgatacggaatttggccggggagagagcagatgacggaaaatacggttagggaagcgtttgacgaatcggaacaaatcattgtgggcatcgagccctgcgacgttttgaccggggggcgggacaaaaaccgcttcctgctgtaccagttgaagcgcagcatggcctgcgcggagcagatcgacattatcgtgtcttttctcatggaatccggggtgcggctgctgttagcggatttaaagcaggctctggaccgcggggtgaaaatccggattctcacgggcaactatctgggaatcacccagccgggagcgctgtacctgatcaaggaccagctgggggatcaggtggagctgcggttttacaacgaaaaagggcggtcctttcatcccaaggcatacatttttcatcgcggagacctgggggaaatttatattggctcgtccaatatgtcccgcagcgccctgacctccgggatcgagtggaactatcactttgacagcctgcgggacagcgggaatttcagccggttctacgagacctttgaggatttattttaccggcattcgattctcatcgacgatcaggagctggcccggtactccagagagtggaagaagccggccgttcaacgggatttggagaaatacgaccagttcggaccggaaatgaaggtggaggcgctgtttcagccccggggcgcgcagatcgaggctctgtatgcgctgaagaacagccgcagggagggcgcgaaaaaggggctggtcctggccgccaccggcgtgggtaagacgtatctggcggcctttgattcacagagctttgagcgggtgctgtttgtggcccaccgggatgagattttgagacaggcggcggaaagcttctataatgtgcgccattcccaggattacggtttttttaccggcagggaaaagaccatggggaaatccgtgattttcgcctcggtgtccactctgggaagacccgcctatttaaacgagcggtattttgccagggattactttgactatatcgtgatcgacgagtttcaccacgcggtcacggatcagtaccggcgtatcatcgaatatttccagccggagtttcttctgggtttgacggccacgccggaccgcctggacggccggagcctttatgagctgtgcgattacaatgtcccctatgagatcgatttaagggatgcgatcaacaaggggctgctggtgccgtttcactattatggaatttacgacgagacggtggattattcccaaatccgcatcgtgaagggcaggtatgcggaggaggagctgaccggaaaactgacggcggggacgcgctacgagctgatctaccggtattactgtaaatacaggtccaggcgggctttgggcttctgctgctcgcgaaagcacgcggagcagatggccaaggaattctgccgccggaatattcccgccgccgcggtgtacagcgacagtgacggggagtacgcggcggaccggggcgaggccgtgcgcaggctgcgggatggcgagctccgggtgattttctccgtggacatgttcaacgaggggctggatatcagcgagctggacatggtcatgtttctgcggcccacggagtcgccggtggtgtttttacagcagctgggcagaggcttgcgaaagagccggggtaaggagtttctcaatgtgctggactttatcggcaactatgagaaggccggagccgcgcccttcctcctgagcggcaggccctactccagcgctgaggccgggaaaatggagccgcgggattttgagtttccggacgactgtctggtggatttcgatatgcggctgatcgacctgttccgggagatggcaaggaagaaggcgaagcgggaggaccgggtccgggaggagtatttccgggtcaaggagctgcttgacggcaaagtgcccacccggatggatctgtttacctgcatggaggacgaggtctttcagctgtgcgccggcatgaagaccagcccctttaaacattacctgcgttacctggacagtcttggggaactgggggagcgggagcgggctatctttgggagcatcggcaacgagtttttggaattgcttgagaccacagggatgtctaaatcctacaagatgacggtgctgctggcattttacaacaacggagatgtcaagacagccattggcgaggaggacatttaccggagctacaaggaattttacggcacggccaacaactggaaagatctggaacgggataaaagcaccagcgatttcaggacctgggataagaaacgctgtgtgagcgaggcgctgaagaacccggtgcatttcctgctgcagtccggaaacggatttttcgtggagcaggatggggcggtgctggcgctgaatccccagctgcatgaggcggtgcgcctgccggggttttccgggcagatgcgggatgtgatcgattttcggaccatggactactaccgcaagcggtatgagaaattgcagttgtagcacggctgcgtttctggtagaatgaataggtgaaattacgcacgacaaggggagaaactggaaatgaccaattatgagatgattgtgctggatctggacggcacgctgacaaaccgggacaaggtaattacgccccggaccaaacaggcgctgatgagcgctcaggaacaggggaagatcgtggttctggcttcaggccgccccacagcgggggtggagcccctggcaaaggaactggagctggagcgcttcggcagctacattctgtcctacaacgggggcatgatcatcaactgccgcaccggagaggtggtgttcgcctcgcagattccgctggcggccaacgagcggattatcggcctggcggaggagcaccgggtggatattctgacctatgagggggaccggatcatcaccaacaacgatcagtgtccctacgctgtgaaggagtccaacatcaaccatctgccgctggttcaggtggagagcatgagggattacgtccggttcgaggtgcccaaattcctcatgctggacgacggcgactatttggtgacggtggaaccgctggtgaaggcggcgttgggcaagaatttcagcgtttaccgctcggagccgtatttcctggaagtgatgcccaaggggatcgacaaggccctgtctctggcgcgcctgctggaggtgctcgggatgacgaaggatcagatgatcgcctgcggcgacggctacaacgatctgactatggttcagttcgccggcctgggcgttgccatggagaatgcggttctgcccctgcgcaaagccgcggactacatcacgctgtccaacaatgaggatggggtggcccatgtggtggagaaattcatgttatcttaaatcattctaaaaattcatgggaagggtagactttcggactttaatatgctaaaatgaatgaagtttgaaagatgaccaaggagagggtaccgaaccatgaacaagaaaatcaaaaccgaggcggtagatcatttgttcgacgcgatcctgacgctgaagaacccggaggagtgctataagtttttcgaggatgtctgcaccatcaacgagctgctctccctttctcagcgctacgaggtggccaagatgctgcgcgagggtaagacctatctggagattgcggagaagacgggcgcttccaccgctaccatcagccgcgtgaaccgctcgctgaactacgggagcgatgggtatgatatggtatttgcaagacttacgccgccggacggacctgccgggacataacggtatggttgatgcatgataagagaacagcctgtacggagccataggcgccggacaggctgtctttcattcatggaatgggctgctggcgcggccggattcctgtgttttctcacttctttttgcggtcccggtcaggggtttcgctgcgcagctgatcggccagcagctcgatcatctgcttctttaagtacacgtcaaaggacagctcgcagatcagcgcgaagagcctcaggtattcctgttcctccccgtccaggccggagtcgccgaaggtgccctgggccttgtcgtatttctgcatcagatcttcccgcaaccggtccatctgtccggccgccagagtgaacacttcctcgtagatgtcctccagctttacgtcggagggcttgccggagaagtggcggctggtaatgggccggaaaatctcctcgatatccgcaaaggacagtacatttttaaaatagtagataaagatcagcatcaacatgtgatctttggaatattttttctttacaggcggagggagcaggttgttcttcgcatagttgttgatcatggttttggttagaaccttgtcctccggatggcgccgggtgtcctttaagtgctcgtccataaaggtggtcacctggtccatatacagatcgatgcccggaatctcccgggatttcacatgggagagggcgcccaggcagtccagcatgtcctgaagccgttcttcgttggttttcatcgttatcacctcatagtcaccattatatagtattcaatactagatgacaagtgggaaatgtgataagttgtaaaaaagggatggtgtaatgtaaatgataacagagactgagacaatggagggagaaaatgaacctgagagaaatgaattatgtggtcgcgatttatgaggaacagagtatttcaaaggcagcggagcggctgtatatttcacaaccgtcgctgagtaaatttctgatcaatctggaacgggagctgaatgtacagctgttcgaccggaccaccaatccgctgactcctacggagtatggcagggcttatatcgagacagccaggtccatgttaaatctcaattctgatatgctgcggcgcatggaggatatccgaaattccgaaacgggtcttctgcggatcgggatgtccgtggtgcgttccgcttactatattccgatggtcctaccggagtttcaccgccgctttcccgggattcagatcagtctggaggaggagtcggccaccgtgctggaacagcatctgctacaggggcggctggatgtggcgattacctcagggatcgtgatggacccgcagatcaactgcgaggtgatccgcagagagcggatttattttgccgtcccccggggatatgtgaagggggcggatgattcctgcaagttcgacgacgttgcgcccttgattccctggaaacagacgcggtttgtgctgctgcacaaaaagcagcgggtgcggcagatcgcagaccaggtgtttgcggattatggtctcgagtcccaggtgatcatggaaaccaagatcaccgacaccgctctgaagctttgcgccaaaggaatgtgctgcgcgtttgtctcagaggtcaccaaggaagatcccttttaccgggatatggaggccgattactatgaattggacgagcgctattccctgccggtcattgcggcctgccgcagaggcgcttatatcccacagagtgtccggtattttctgcagatactgaacgagggagaccggtagcgcatagccgcttatggagcggcggattgtccccctacaaccgcccggctatgcccacatgtaaaaacggtattgggaatcaggaaacctcactgctataatgggattaacgcagatagaccggtatatctgaggaaactggacattgtggcaggcgattgaatttggaggggtaagtatgagcagtacaatgatagcagtgatcggatttgtttcgctggcgatattgatgtgggtgctgttgaaggggatgaccagcccggtgataccgtttattttgataccggtcgtcaccgcgctgattgccggtttttccatcagcgatatcaacggatttgtgaaatccggcctgagctccgtgctgagcacggcagcgatgtttatgttttccatcacatattttaatataatgaacgatgcggggttgtttgagccggtgatccgggcgctgacgcctaagggaaaggcaaatgtatttctgatcttgctgtccgctctagcggttacctatgtgggacatctggacggctccggggcgaccacctggatgatcgttctgactgcgtttctgcccctggccgaccgggtgggaatccgccggcccgcccttctctgcgtggcggcttccggaatgacggcggccaatctggtgccctggggcggccccaccatgcgggcggcggcagttttggagatggatgtgaacgcgctgttcgcttatattctcccggccctggccgtgatggtggggttgtcggtgctgacggtctggatgttggcccgggctgaggtgaaaaacggcgcggggaccatgattgccgaaaccgcatgcaccgcagggaatcatgtggaaccgggcagaggcggttttaaggactggaaatggatcttcaacatggcgctcacagtggcggtgctttatttcctgttcagcggcgtcatgtcatcctatctctgttttatgatgggcgtctccgtggctctgctggtcaattatcccaatcccaaggagcagacaaaacgccttaaatcctacgccggacagtctatggttatgacgattacgctgtttgcggtggcggttttcctgggcgtcatgaaagaaggcggttttatcgaggcgatggccagcgtaatcgtccgaatcattcctggctttttagcgccccacgcccactgggtgctggcgttgatcgcggttcccatgatgatggccctgggcacggacgcgttttactatgtgatgctgccggtgattatcggggtggtggagccgtttggaatctccgcactgtccgtggctgcggtttatctcatcaccggaacctttggctccagcatcaatcccagcggcgctgcaatgtatgtgggcctggggctggcggatgtggatgtggggacgcatatcaagttctcgatccggtatctgtggccgttcagtatcgcctgtatggccgcggcaatcctgatggggattgtacaattctgatggaaggatgagatcatgtcgatggatgagaaacggtggatcgatctgagaagcgatacggtcacagtgccttcacgggagatgctgttaacggttttggaggcacagatgggggatgacgggagaagaattacgccggaaacgggcggggacgggaccgttaatgagctggaagcattggcagcaagaataacgggaaaagaagcggcgattctgtttccctccgggaccatggccaacacggcggcgcttttgacttgggcaaaggccggggatacggtgctggtggaccgtcttatgcacttatatcttcgggaaaaaaccggctttgtacctgcgcttggggggctgctgccggtgttctatgacctggccgcaaacggcagcccggatatggagtcggtgaaaaatgcgttgacagctgcgtctgtccgcctggcctgtattgagaccacccataatttttccggcgggagctgtcagccgcctgacgagctggcgcagtttaaggaattgtgcggacgagctggcattccggtccacatggacggcgcgcggctgtttaacgcggtctgctctctggaggtggaggtggaggagatctgccgctatgcggattctgtgatgttttgcctttcaaaggggttgggggctccggttggttcgctgctgtgcggttccagagatttctgccgccgggccagggaaatgcgcaaggctttgggcggagccatgcgcaaggccggggtcattgcagctcctgggatttatgccctaaaacacaatgtgccggggctaaaggaggacaatgagaaggcacggtatgtggcggaacgcctgaggaaacttgagaaggcgtttcccatccgcggctcggtgccttcaaacattctgattctggaaactgccggagaagaaacgtgcagggccctgatggaggcgctgaaggttagaggaattctgtgcaacaaggtgccgggccacggtctgcggtttgtgtggcacaatggggtgaactgggaggataccagattggcggcagagcttattgttcaggctgccggccggatcaaagcgtgtgggggaggtgaagccaatggaatatgatctgttggagaaccgggaatttgaggattggctggttaagctgcggagggagtttcaccgctatccggagccgggatggctggaataccggaccacggtgagaatcatagaggagctggaacagataggcattcctgtgatctgggggcgggatctgtatgctgcggattgccgtctggggctgccggagccggaggaggaccgggcggcggtccgccgggcgatagaggaaaccaaaagggaggatctgattgccgggatggcggggggatttaccggagttatggccgtgatcgaagggaagcagacgggtcctgccgtgggtatccgggtggacattgacagcaacgagctggaggagtcggaggcaccggagcaccggccggcccgggaaggctttgcctcggtgcacaggggaaatatgcacggctgcggccacgacggtcatgcagccattggactgggagccgcccggattctctgtgccaaccgcgaaaaactgggtggaaccgtatatctcttttttcagtcggcggaggagggcgggagaggcgcccaggctgttgtgaaaaagggccttctgtccaatctggattatttttatggaggccatatcggtatcaaccaggctcccttcggcaccatttccgccagtacctacggatttatggccgggaccaagtttgacgtagaattctatggccgcgcatcccatgcgggaaaagccccggaggagggggccaacgccatcgcagctgcggccggagctgttttgaatctcttggccatatcccggtccggtaaggggatcagccgggtcaacgtggggaaaattcagggaggaagcggtcggaatgtgattcccgattacacgcttctcaaggcggagaccaggggcggaagtccggaggtcagcgcgtatatgtttgaacgtgccatgagcgtctgccgtggagctgcgcaaatgtacggctgtgatatgaattgccggattatgggggaatcccggaacgcggagtgcgatggggagatggttcgttttgtagagcggtctgccgcagaactgcgggaaataaaagagatcattccggcttcagacatgggggcgggggaaaatatcacgtttatgatgaacgaggtaagccgtcagggcggacaagccacctttatgctgttgggagcggatattaaagcgccccatcacagctcgacatttgattttgacgagcgggtgattccgctggcagccagactgtttgcaaagctggcgctggatttgaaatcagagaaacggaaatgagcgtatgcctgccggccacaaaccggcaggcatttcacacgcgagccaccgtgtgtattttccctccggaaatgccatactatccttgaggtgagcacatggaaaaagacaaagaggaaaaactcaatcaaaagaagtctaacgaaatgttcaacagcatcacggaaaaggtgaagccggagaaccagaatcagacccacaattcccgccgggaaggaatgggacccaacacgaagcgcaggccctgctgatccggctgcgtgagggaatgtccgccgcgcctgcaaggtggtaggtgacaaatcgccgaaaatgttataagatagactttgcagcattcgcagccccgcctcggcggggcggacaaaccccgcgagggggacaaaaggcggtaagaaaagaatgagtatttacgattcactgaatccaatgcagcaggaggccgtgttctgcacggagggcccgctgttggtgctggccggggccggctcaggcaagacccgggtgctgacccaccgggtggcctatctgatcgaagaaaaagaggtcaacccatggaacatcatggccatcacatttaccaataaagcggcgggggagatgcgggagcgcgtggacaagctggtgggcttcggcgcggagagcatctgggtgagtaccttccactcctcctgcgtgcgcattttgcgcaggcatatcgaggcactggggtattccaccagcttttccatctatgataccgacgaccagcgcacgctgatgaagcaggtgtttaaaacactggacgtggacactaagcagctgaaggagcggggcgcgcttagcgcgatctcgtcggccaaggacaagctgatcgggccggaggaatttctgctgaacgccaccggggatttcagacagcggcggattggggagatctaccaggagtatcagaaacagttaaagaagaataacgctatggactttgacgacctgatcgtcaagacggtggaactgttccagaacaacccggatgtgctgagttattaccaggagcgtttcaagtacataatggtggacgagtaccaggacaccaatctggcccagttcaagctcatcagcctgctggcggcaaaatacaagaacctctgcgtagtgggagacgacgaccagtccatttacaagttccgtggggccaacatcgagaatatcctgaactttgaggatgcgtttccgggggccagggtgatcaagctggagcagaactaccgctccacccagaacatcttaaacgcggccaacggcgtgatccgccacaaccggggacggaaggacaagacgctctggacggccaacagcgagggcacgctggtgcatttcaaacagtttgagaacgcacgggacgaggcggactatgtggcccggcagatccgggacagcggcttctcctaccaggaccaggcggtgctctaccgcaccaacgcccagtcccgtcttctggaggagcggtgcatatactacaacgtgccctatcgcctggtgggaggcgtgaacttctatcagcgcaaggagatcaaggacattctggcctatctgcggaccattgccaacggcgtggacgacctgtccgtgctgcggatcatcaatgtgcccaaacgcgggatcggagccaccactatgggcagggtgacgattttcgcgtcggagcacggcatgagcctgtacgacgcgctgaaggcggcccgccaggtgccggggcttggcaaggccgcgtctaagatcgaggctttcgtgggccagatcgacagctttaaggttcgggcaaattccgaggactttaccatccaggacctgatcgaggggatcctggacgagaccggataccggcaggagctggaggcggagggggagatcgagtcccagacccgcctggagaatatcgaggagttggtgaacaaggccgtcagctatgagcaggacagcgaacacccctccctggacgagtttttggaacaggtggccctggtggcggacatcgacaatatggacgaatcagagaaccgggcgacgctcatgaccctgcacagcgccaagggcctggaattccccaaggtgtacctggtggggatggaggacggtttatttccgagcatgatgtccatcactgcggacgacaagtcggagatcgaggaggagcgcaggctttgctacgtgggcatcacccgggccagggaggagctggtgatgacctccgccaggcagcgcatggtcaacggggagacccgctattccaagcccagccagtttgtggaggaacttcccgcctccgcggtggaatttgaccgtctggagccggccctgtccgggtacggcggctttggcggaggcagcgggagcgccggaggttccggacggaaaacggacgcttatgcggacgactccctgccctggaatcagggcggcatgaaagcgcagcccaaggccgaggggaggggatttggcagcagccacaacccctatgcttcccggaataccgctccggcccccgcgtcgaaaccggcctttgggaaagcatttaccgtgcagaaacagtcgtctttggactacggacccggcgaccgggtttcccacatcaagttcggtcagggaaccgtgaagtccgtggaggacggagccaaggactatgaggtcacggtggagttcgacaaagcaggtcagaagaagatgtttgcgtcgtttgcaaaattgaaaaaaatctaggatacgactggataaattctaaaaatttgagtaaattgggatagtaaaaaaggcctgatcatgatataatacttaataagcatttcaaccaggctgaatcgttaggaggaaaggacgtgggcaatatgaaccgatttgacagagaccgctttgatgcgatggggaaggaagctatgagccgtgtggaagagattatgaattccaccagactgaacgagctgttgcatagaaaagaggaagaagataagaaaaagaactgtatcctgtgggtgttagccatcatcggcgctgtggcggcggtggcgggtatcgcatacgcggtataccgtttctttacaccggattatttagaggacttcgaggatgatttcgacgacgacttcgacgatgatttcttcgaggacgaggcggtggaagagaagaaggcttccaaggaagaggaataaagaacggattatggatgaaggctcccggtttcgggggcctttttaaatagctgggccgggcttgcagaaaagtccggcctgtctgcatatctgcggggaaatgagaaccatttgaggaaatttatccctgaaaatagtagtagttgacgctcacaatggtaatacccaccgggggattattcagcctttttttgacctctaaaatcactctggtgattgagtcgaaatagttccggctgttctcatcgatcaccggattccgcgtggacaccacgcgcacaccggaactgtcgtcgccgcagctgtaatccgcatcgcagattaaaaccgttttgtcgaccacggcgtttacaaagcagccgctggaagccttctcgttcgccgcagccgcggcccacagctgcgtcacgtccttcatacaaaacggtttgccgccgacgctgtaaaagttgatcatataccgctctgtcatcatagcggaaaaacctctttttggttagattatgcggaaattgaccgtctgtgcaaaacgcctggagggggaacggcaatcaaaaccggtttgtcggaatcaccattcaaaccggtacacaatcctgcgccggtaatcctgccccggcctggtaagcgcccaggtttccggggcaaaatgaggcgcatccgggatgtcctgggcttccagggctacggcgcaggagggggatgagacggcgccccccgccaggcggtaatggtctccgatgtagccgcctgaatataccaccacacagggcgcgtccgtcagcagggtgaggctgcgtccggaggcggaatctctcatggttaacgcttcccgaagcccggcattctgtctcccgaacgcctccgtctccaaatccggcgcagcctcccgccccgggcccaactcctccagcagaaacgcgttgttatagcccaatgcgttgttcaactgagggtccaggggccaggccgagatctgaccggccagagagaccggccggctgaagtcaaagggggtgccaaggcagagctttaccgcaactgggatatggcggctgtcgttggcgatgtagcggttcccgcggacccggagaatctgatccaggccggagcggcaaaaatccccggacagattgaagtagctgtggccggacagattaaagtaggtgggccggtccgtgacggcgcagaaggaaagctccagctcggaatggttccgcaatgtataacaaattttcacaatgcggtttccgggaaatccatccaggccatccggcaaccgcactgaaaatgaagcggagcaaaaatccctgcccgccgccgtagcgtccagagtccagacacggtgggaggcgcagcccgggccgccgtgcagattgctgccgttatcgttgtcgctgaggggcagggatctgccgtccaggtacagtgaaggcccggaaatgcggcctgcgcaggggcagaggactgcgcctgcaaacagcggattgccgatatagtcctcccagttctcaaagcccaggacaacatttacagttctgccgtcccgcccgggcagaagaatctgacggatggcggctccgtaagagatcaggcagacttgcattccgctgtccgccttcaggcacacctcccatacctcctgaccgccggtttgtccggcccgatgtttttttacctccatttcacgcgctcctctccggatttcacagtatttcctattatgtattatagcgaaacgccgcaaaaaagatcaagaattgaaaaatgattgagcaaattttacaaatacaacggcaatttaccctaatgattctcgacaaaattccggatataataaagaaaatcatacaatagcggatcacaaaaaaatataatgagttccgaattatgcaaaagaagccgaagcgattccatatattagcagacaggaggacgtggagatagtacactttagtcagtaacaggaaaagaggtgtatgatttggaacgagtcattcaggcagtggccgagacctgcgggctgggcgagggctgtatgtgggatcgggagacggggagtctttattttgtggatatcacgggctgccggatttaccgttaccggccggaggagaaccgtctgagtttttgcgggacccgtgggccggtgggctgtgtgtttcccactgcggatcacggcataggagccggggcagggcgctccatcatacggttggagaaggacctcaccggggaacggacgctggcggagcttgattttcccgcatatctgcggttcaacgacgggaaatgcgatccctggggacggctctggatcggaaccatggcaaaggatcaaagccatcccggagcgctgggaggcggaagtctttactgtatgagcggtggcaggagtttgggagttcagggcggatttaccattcccaacggcctggcctggagcctggaccggagcaggttctaccacgttgacacccagacccggaaggtggatgtgtacgagttggatggtccggaccggatgtccggcaggcagacggcttttcacattcctgaggaggacggagcgccggacggcatgtgtatggacagccagggcaatctctggatcgccatgtggggcgcggggaaagcggcctgctacgatccgtccacagggcgccgcctggaggagatagaggttccggctgtaaacgtctcctgcgtcgcttttggcggagaggacttgaaaaccttgtatatcacgacggccagagatcaacggggagacggcggcgcgctctattgcgtcaggcttccggtggcggggctggccccttacgcatacggagggaacgaagatggaaaataaaacggctttgattaccggagccgccaagggaatcgggcgtcagatcgccatttccatggcaaaggccggatacgatatcgcggtgaactaccgcagcgacagacaggcggctttggaggtctgccgcatcgccggggagagcggcgtgcgcgcgtttccggtgtacgcggacatgtcggtggtggacgacatccgcggcatgtacgatcaggtgttttcacagttcggcgcggtggatgtgctggtgaacaacgcgggcatcagcagcgaggtgtattttctggacgccacggaggagatgttcgaccatatgaccgcggtggactggaaaggcgtgtacttttcaagccagattgcagcgaagcgcatgatcgagcgtgaaatccggggcgtgatcatcaatatcgcctccaaccaggtggacggctgctggcccagggccacgatctacggtcccaccaaggcggcggtggccaagttcaccaggaacgcggccatggagctgtcgcttaaaggcatccgcatggtggcggtggctccggggtacacggacgtgggctgggagccgggggatatccggctggaggctgccaaacggctgccaatgaagcgttttgccaccaccgaggagatcgcccaggcggtgatatacctggcctcggacgcggcggactacataacgggcaccatgctgaccatcgacggcggggccaccctgcccgtggtggctgccaacgattttgtgtgagaggtggcgcgggactatgacagatgacggttattataacagcctgctcaaaggggattcgggggcgctcaaacgggcgctgtacaagtccatgggatttacggaaaatgctctgaaaaagcctctggtggcggttgtgaacacatacaccaatgccacgccgggccatttcaacttaaatgaactctgctgccaggtagagcgcgggatcgcggcggcgggcggaacggccatgaccttcgggacgattgcgccctgcgacggaatcgcggaggggcacatggggatgcgctacattcttccctcccgggatctgatcaccgcttccgtggagtgcatggtgcgggcccaccggtttgacggcatggtgctcctgggctcctgcgataagattgtgccggggcttttgatggcggcggccaggctggatatcccggccattttcttaaacggcggccccatgctgccggcctcgtacaaggggaagcattacgacggcaacattgtcaccgaggccgtgggctggaaagcccgcggggagatcggcgaggcggagttcaaggagatcgaggatctggcggagccctgcgtagggtcctgcgccatgctggggacggccaacaccatgggctgcatggccgaggccatgggcatgagcctgccgggtacggcggcggtcccggcggtctactccaaacggctgcaggcggcttacgacaccggcgaggcggtgatggagctgatccggggcgggattaccgccagaaggattatcaccggagagtccattgagaacgctatggcagtgctcatgggcatgggcggctccaccaacggcattatgcatttacaggcgatctataaggaggcggggctgggagagctgccgctgacaaaattcggtgagatgagcgggcgaattccccaggtagcttcggtctacccggcgtccccttacgatatggcggatttttatgaggccggcggggttcccgcggtgatgaaggagctggaactgtttcttcacaccggctgtctctgctgcaacgggcgcacggtggcggagaatctctcccgtgcggcccattccaccgcacgggaggtgatccgcaccgcggagaatcccttccatcccacgggcggcgtggcggttctgaccggcaatatggctcccatgggagcggtggtgaagccggcggccatcccggacgggcttctgcggttcacgggcacagcccgggtgtttggcagcgaacaggaggcctgcgcggccatcctggccggggatatccggccgggcactatggtggttctgcgctacgagggccccaagggaggtcccggcatgccggaaatgtaccggcccatgaagtgtctggagggcatggggctttccgacagctgcgcggtggtcacggacggccgtttctcgggctccaaccgcggctgctttgtgggacatatttcgccggaggcctatgagggcggcgttttggcgctggtggagaacggcgactccatcgccatcgacgttccggccggaagccttgagcttttggtggatgagccggagctggagcgaaggcgcgggcgttggacccggccggaaaaggacgtggagcccggttatttgaacacttaccgcagaatcagcaaatcagcggcgcagggcgcggttgtagaataggagcgtggaatgtttacctggaaagacgacagagagctgttcgccatgatgcgcgcggagctgtactccgccgtgatcggcgacattttagataaaatgcaccgttaccatcaatttctcccggccagagttcagcccatccgggaacacatggtggtggcgggccgggcgatgacggtgctggaggcggacgccttcgaggagctgtccgacgggcgcaaccccattatgaaacagaatttcggcctgatgctggaggcgctggacgatttgaaggagaacgaggtctacatctgcaccggatcctcccccagctacgctctggtgggagagctgatgtgcacccggatgcagatattaaaggccgcgggagcggtggtgaacggataccaccgggacaccaagggcattgtggagctggatttcccctgtttctcctacgggcgctatgcccaggatcaggggccgcggggcaaggtgatcgacttcagggtacccatcgagatcgagggcgtgcgggtgaatccgggcgatatcgtgttcggcgacctggacggtgtggtgatcatcccgaaggagatcgagagggaagtgatcgagcgggcgtatgagaaggccacgggcgagaaaatggtggccgaggccatccggggcgggatgggggcgaaggagtcctttgaccggcacggaattatgtaaaggatgatggcatgaacaagttggaggattccattctgaagcttatggcggcgggcgggcacacggtggtgatgcagaatgccggcatcttccggttcccgtccagctaccggtttgaaacccacagccacgcggcctacgaaattatctacgtgaacgcggggcggggcatcatgggcatcggcgaggagtatgtgccctttaagccgggcatctgtatcatcgtaaacccctatgcgccccactgctttatcgtggattcccagaaaacctgcaaaatcacccaggtggagatggcggtattttcccagcccggagcctgcagggggatttcatttctggagaaccgcaccgcctactaccgcatcggcaactgtgagccggtcaaccggatgttggaaaatatctgctgtctgaaccggctgcggcgggaggacagctacgccaaggcccagatggatttcgccatggcgcagctctacgccgggctttcctactacatcgacgagcagaaggaggaaccggctgccggaggcgacaaggtggggcggctgatccgctatatcaacgagaacctggagggggagttaaacattgaagaactctccgggcgcttcggggtgagctcccgctatgtgcgcaagtattttctgcagcagatgggcatgaactgcaacgagtacattaccatactgcggatcggcaggaccaaggacctgctgtgcgagccggcccactccatcaccgacgtggcgctgatggcgggattcaacagttcccagtatttctgccggatcttcaagcagcgcgtgggcatgacaccggtggaataccggagaatgtggcgtgatggcgggatggaagcagtgagcgagtgagaagcaaaggagggagagtatccatgggagatatattggaattcaaaaacatatcgaaatattttccgggcgtcaaggcgctggacaacatttgctttaaggcgtacagcggcgaggtgctggcgttccttggggagaacggagcgggaaaatccaccctgctcaaggtactcaacggagattaccagccggacgagggggaatacctgatcaacggagtgcggaagcatttcaagacgccccacgaggccatcgaggagggcatcagcgtgatctaccaggagcgccagattctcatggagctgacggtagccgagaacatttacctggggcgcatgccggtaaaccgcttcggcgtgatcagcacccgccgggccaacgagatggccggccggatcattcaggacttcgggctgcccatcgaaccggacacaaaggtgaaggatttgagcatcgcctaccagcagatggtggagatcatgaaggcctacagccgggagaacctgaaggtgatctgttttgacgagcctacggccagccttagcgactcggagatcgagagcctgtttaacatcattgccaagctgaaaaaagagggcaagatcattatctacgtgtcccaccgcatgaacgagattcagcagatcacggataaggtggccattttcaaggacgggcgttatgtggacacggtggtcaccggacaggtgccggagagccagatgattaagatgatggtaggccgggatctgggagatatttacaaaaatctcgaccgggacaaggagatcggcgaagtgctgctggaggtgaaaaacgtttcctcggactacgttaaatccacttccttcaccctgcgaaaaggggaggtcctgggattctccggccttgtgggagccgggcggaccgaggttatgcgggccattatcggcgcggacaaaatgaagaccggcgaggtttggctggagggaagaaagatcgtcaaccgttcccccaaggaggccatggacaacggtattgtgctggtgccggaggatcggaaaatgcaggggatcctggccaacctgagcgtgaaggacaacatcaatatctccatgctggacgccaactccaaccggttcggcgtggtggactccaaaaaggaggaggagatcgccagtcaggggattgaagatttccgtatcaagacgccgtccccggacaaaaagatcgtggagctctcgggcggcaaccagcagaagtgcatcgtggcccggtggctgaccaccaaacccaaggtgttgattctggacgagcccaccaaaggaatcgacgtgggcgccaagtccgagttttacaacatgatctgccagtttgcgaagcaggggctgggcgttatcctcatctcctcggagctgccggaggtaattggactgtccgaccgcattatcgtcatgaaatccttaaaagtggcgggggaggtttccagagaagaggcgaccgagagcaagctgctcagtcttggaatgataggagagagtgaatcatgaaaaatatgggaaaattgaaaaaaataatcggcggcgacaagttggtactcatgggcgccattgtggcggtgttcatattgtttggctccctgaattccaacttcctgtccatgaccaacatcgtcaacctgctggtggcggcttccctggtgggactggtagccatcgggcatacatacctgatcattgcggggcagaacgacttgtcacccggctccctggcggctctgtcgggcgtgatcgcagccattctcgtcagctggggcgtgccgttttttgcagccgtgctggtgaccctggccgtggcggccgcggtgggcgtgttcaacgcgtggatggtgaataagatcaagctggaggcgtttatcgcaaccctggtgacccagtccattatccgcggcttcgcttatattctctgcaacggcaagccggtggcggtcagcgacaagacgtttatcaccctgggcaaggcccgggtaatcggaattccagtatccgtatggattatgatgatcgccatcgtgatcttcggttttatcctggctaagactaagttcgggcgcagcatctacgccatcggcggcaataaggacgcggcccgcctggccggactgaacccggagcggatcgtgaccatttcctacatcatgatgggcgtgctctgcggaatcggcggcgtggtgtttgctgcccgcatgaactccggacagccttcggcttgtgtgaacttagagttcgacgccatcacggcggtcatcctgggaggcgtgtcctttgcgggaggcgtgggaaccatgggcggaacggtgctgggtattatcctgatccaggcctttaatatgggcctgaccatggtcaacgtgccctccttctggcagtatgtggcccgcggcggcctgctgctgttcgcattgacgtccgactttatccgcaagagaaaccgcgacagaagcctgctggcggccagcatgaagaattcgtagagccggttaaccgattgtaacaagctgtacttgaaacaattcacacggaacagggtgtgttttgaaatattgacaaaaaaaggaaaaggagaagagaacatgaaaaaaacattatcggtactgatggcaatggcaatggcggcatccctcgcaggctgcggaggcggagctgctgaaacgacaacggcggccccggcggctgacaccacagcggctgcgaccgaggccgcggccccggcgggtgacaccacagcggcggacacggcggcggcttccgatgagaagctggtggtatacggaatttacaaggcgggtgaccagacctggtttatcgacgagggcgcagcggctcagaaggccgtggaggccgcgggcggcgaattcatctacgtggacgcaaaaatgagtcctgaggaatatttgaaggcgatcgacaacgccatcgccaacaaggcgtccggtgttgtgacctgtattccggaccagaccatgtcccaggccgttgtggacaagctgcaggaggccaatatcccggttgtggcagccgacgacgcgcttcaggatgccagcggcgagaagctggttccctgggtgggtatcaacgcatatgtgatcggcgaggccaacggcgagtggctggccaactatgccaaggagaacaacctggcgactgaccccgaggtcgggctgctgcttatgaccatggacaccgtttccagctgcgttccccgcgcagagggcgaatacgacaagtttaccgagctgtgtccggatttcgacaccagcaagatcttcagggccgactatgacggcaccacggataagggaaatactgccgccaccgctgtgatcaccgctcatccggagatcaagaaatggctggtaaccggcgccaacgaggagggctgtgtgggagccgcccgcgcgctggagagcgccggactggacgcggacgcctgcgtggtaggactgggcgcgtacatggcaaaggatgagttcaagaaggagggcggttcctgcatgaaggcttccgcttacttctccgcagacgctgtgggcgcgggttccgttaacgttctgctggacatcattgcaggcaaagacgttcccatggaaaccgctgtggacgcggttgtggtaactcctgagaactacaaagaggtaatgggtgcggccgctgagtaaaactcggaacgagctgtgcggattccacgcatgggacggggcgcctgcaattcaagcaggcgccccgtttgcagaacgccgctccgggcattcgggcggtgaagcctgccggggaaaagacgccgcagggcgtgaccgcgttcggctatgaactctggcggtattcgcttggggttgatcccacccactttttaaaggtggtacagaaactgctttcgttggaaaatccggtgcggaagcatacctccttgatggaggtggcgggaacgttcttcagcaggaacttggccgcattgatgcggatggcaatcagatactcgtggggcgtgaagccggtctctttcttgaacagccgggtgaaataataggggcttaaggaggcgcgggcggccagctgctccagggtgagcggttcggtcatatgctcgctcatataggcggtggtttcctcgatgacctcggactggaccgtgccgccagcgtggctctcccgggagaccaagagcgcggtgagcacgttggtgatgtactgggaaaccaaggcttccttgatggaggcgttttcccggaacagctgatagatcttgcttaaatatttgtcgaatttgtaatcgtcctttaagttgaggacagggcctgtgtctgcggtgatcatctgaaaatactcccgggccacagggccgtcaaagtgaagccacagggtttcccagccggtattggtgtaataagagtggggcttgtagcagtccaacaccacgatctgccccgccccggcggtataggtctggctgtccagcttgacggtgcagcagccttttttgatatacatgatgagaaaactgtcataggaattccgcttcagacagtatccgggcgcataacggaaataaccggtacacacagggtaaaaaaaggtcttgacagcctgggtgctgggcgtgtacaggtagtagtcggagctttcaaaaactcccggttcagtggagcgcaacagagattccccctttcggctaattactcttattatagggggaagcagggaaaaggtcaagaaaataaaaaagcaattttttgaaattcataggcaagttaaacgaatgaaaaatgaatgaaatcaatgtatattaggattgttaacatagaagtaaaatgagtttttttataaataacgggacaggaggaacacttatggagggcgcaagaatctgggaggagcaggtggtgattcccacctacgagatcggggaagcggataaaaatcccatattcctggacaagcgggtgtaccagggcagctcaggcaaaatctatccctaccccacggtggagaagatcagcgatgagccggcggacaaggtttaccaggcggtttttctggaaaatgaatacatccgggtgatgattctgccggagctgggtggaagaatccagcgggcctatgacaagaccaacggatacgattttgtctattacaaccatgtgatcaagcctgcgttagtggggctgtgcggcccctggatatccgggggaatcgaattcaactggcctcagcatcaccggcccaccacctttatgccggtggactatcagctggcggagaatggggacggaagctgtacgctgatggtaaacgatgtggatcagatgtacggcaccaaaggcatcgcagcctttacgctgtatccgggcaaggcctatattgaaatcagagggcagctctataaccggacgcccatggaccagaccttcctctggtgggccaacccggcggtgccggtgaacgattacacccagtccattttcccgcccgacgtacacgcggtgatggaccacggcaagcgggacgtttcccgtttccccattgccacgggagtgtattataagcacgattacagcgagggcgtggacatttcccggtacaaaaatataccggtgcccacctcctatatggcggagaaatccaagtacgattttgtgggcggctacgactaccgggagcgggcggggattctgcatgtggcggaccaccatgtgtctccgggcaagaaacagtggacctggggctgcggcgatttcggcagggcctgggaccggaatttaaccgacgaggatgggccctatatcgagttgatgaccggcgtttatacggataatcagccggatttcacctggttgaaaccctttgaggaaaaaacgttcaagcagtattttatgccctacaaggcggtgggaccggtgaagaacgcgacaatccacggggcggtgaatctggaggtccggacggagggcgtgtatgtgtgcgtttacgccacggagcgctgtgagggggccgtggtgcggctgacttacggctcagatgtgatttacgaggagaaaacgcagctgtcgccggtggatatctatgagaaaacgctggatctggcggttgaggatgaaacgcggctgaaggtggaggtggtatccggaggccgggttctggtggcctaccagccggagaagcaggagattgaaacggtgccggagccggccaaggcggcggaggatccggagcggatcatgacgaacgaggagctctacctgacgggcctgcacatcgagcagtaccgccatgcgacatacctgccggatccctattatctggaagggctgaagcgggaccccggggacatgcggattaacgacgcctatgggctgctgcttatgcggagagggttatttgaacgggcggaagagcgttaccgaaaggccgttgagcgggctacctggaagaatcccaatccctacaacagcgcgccctactacaatctgggcctgagtctttggtatcaggggcgggacgacgaggccttcgacgctttctacaaggcaacctggtccaacgagcagcaggagatgagcttctactatctggcggcgatccaggcccgcaggggaaactttgaggcggctctggagatggcggaaaaggggctggtgaagaacgcccacaatgtgaaggccagggggctgaaggcgtatgtcctgcgcaggctggggcgcgtggatgaggcgaagcgctggatcggcgagaaccggaaggtggacgcgtttgactatgtgtcgatgttcgaggaggcaatgctggcggccgggaacaccgaggcggcggaatgctgcgggagcgcgggggctggggagccctgcgggatcccgggcgaaaagcagcactccacaggcggcagggcagtggtgttggaggagatgaaccggctgatgcggggattttctgagaactacctgcaggcggccagggactttgcggagttcggcgcgtatgaggaagcgtccgcgatgctatgccaatgcgcagcggataagcctatgctgttctattaccaggcgtactatggggagcgccgggggctgggaagcgaggctgtggccgggcttttgggccgcgcggagagcgcctgcccggactactgtttccccaacaagctggaggatattccggtgctggaatttgccattaaggggaatccccggggggcgaaggcatactattacctgggcaacctgttttacgacaagctgcagtatgagcgggccaccgcgctgtgggagaaatccgccgcattggatggcagtttcccggtggtgaaacgcaatttggccctgtcctactacaacaagatgggacgccgggacgaggcgcgggggatgatggagcaggcctttgagctgaacacggcggacgcgcggattttcctggagctggatcagctctacaagaaattgggtgtttccgccggggaacggctggaatattatgaggctcaccgcgagacctttacacagcgggacgacgcggtgatcgagtatataacattgcacaaccaaacggggaagtatcaggaggcttacgatttgaccatgagccgccggttccacccctgggagggcggcgaggggaagatcaccacacagtatacggtggcgctggtggagctggccagagaagcgatcagaaacggagcgtttgagaaagcggaggaactgctgggccgtgcgcttgtgtatccggaaaatttgggcgagggcaaattggaggggaccaaggacaaccatatttattactatctgggctgtgtaaaggaggctctgggccgccgggaggaggcgcgggagtgctttgaacgggccagcgtgggtccggacgagccggcgggtatgatgtactattacgatcagcccgcggatatgatcctctatcaggggttggcaaagctgaagctgggaaagaccggggaagcgaagtccagattctatcgtctgatcgattatggcgagcagcacatcggggatcacatgcgcatcgagtatttcgctgtttccctgccggattttctgatctttgaggatgatctggatgtgaaaaacaaaacgcactgctgttatctgatgggccttggaaatctgggccttggaaaaaagcgggaggcggaggcattcttcgcccaagcgctggagctggacgggaaccatttaaatgcgatccggtaccgaaggggcgtttgatgagcggagaatgagatagggagtgaggaagtttgagggccgttggcctttcgcggataacgcggagggctgacggcttttttgtgagggtgggaggaaacgggaggcgggggcttccggtcttccacgagcatagtgtttatggtatcgtatgaacacttgacgaggtagtttacgagtctagtgagaatacatagcgaaacacttggcgaggtcttccacgagcttagtgtttatggtacaataggtgaagccggaaacccgaatatgccatgttcggcacccggcggaagaaaatgaacgaggagaattgacgatgaaaaagggtgacctgtttgaagggattgtggatgtgatagaatttccaaataaaggaattgtaacggtagatggggagcggatcgtggtgaaaaacgctcttccgggtcagaaaattcagggcgtgctgacgaagaagcgcaagggcaaaagcgaggggcgtttgctgaccattttggagccgtcgccaatggaacgccccggggagacatgcgagcattttggaacctgcggcgggtgcgtgtaccagagtctgccctatgaggagcagttgaagatcaaggagaaccaggtgaaggccctgctggatccggtggtaaagcccggcagctatgaattccaggggatcaagggcagtccgatttccgacggctaccgcaacaagatggagttttcctttggggacgaatttaagggaggtcctctggcgttggggatgcacaaaagaggcagcttttacgatattgtgaccacgccgggttgtcggattgtacatgaagatttctgtaaaatactggaatctacgcggacatattttgcggagcttgggacggcatttttgggaaaactctcccacaagggttatctgcgccatctgctggtgcgccgcgcggtgaagaccggggaggttctggtggacctggtgaccaccacccagacggagtatctgggagtggacatgcaggaggaccaggtgttagagggctggaaggagagacttctgggattggagctggaggggcggttcgcgggaattctgcataccttaaacgactctctggcggatgtggtgcagagcgaccgcacggatgtgctgtatggacaggattatttctatgaggagcttttggggctgcgcttcaggatctcgccgttctcatttttccagaccaattccctgggcgcggaagtgctttacgacacggccaggagctacgtgggggagacgaaggacaaggtggtattcgacctgtacagcggcacgggaaccatcgctcagatcctggccccggtggcgaaaaaggtggtgggcgtggagatcgtggaggaggccgtggaggccgccaggatgaacgcgaagttgaacgggctggagaactgtgaatttttggccggagatgtgctgaaggtaattgacgagatccaggacaagccggacctgatcgtggtggacccgccgcgggacggaattcacccgaaggcgctgaataagattattgagtttggggtggaacggatggtttatatttcctgcaagccgaccagtttggcgagggatttggtggtgctgcaggagagagggtatagagtggagaaggggggagcggtggatatgtttccttcgactgggaattgcgaaagcattgtgcttttgtccaaacctactgccatctaatgtattaaagaaaatctaaaactgtatgaatggagttctgtaagcaatagtagaatatttgggacagaaggaattccgtaaattagataattaaatatatgaatgaaagaggcagagacatatgttgtgtaaagtcttggcggacagcgacatgggctctgcttctcttatagaaaaacgttattagattgatgtggaactagagatggtgggatataagcagtaaagcgcggtttaacatgttatatagtatatgtaacttgttttctgatgtttttttgtatgatcaatggtataataataaaagctatatgagaaaactaaaaagacaatatctgaaaatgatggatggaagcgtgggtgtaaggcagatggcagatatactgacaggagcaaaatttgaaggtgattataaaaaatggatatctgaagtaagcaatcgttttaaaaccagtcaaattaaggcatctataaaagtaaatgatgagatgcttcgtttttattggcttcttggacgagatattgagacattgaagaagaatgtaacatggggcagccatgtttatcaaaagataagcaaagatttagtaaaagaactgccggagatcaagtcattttcgccaagaaatctacaatatatgaatcagttttacaggctgtattcggatgtagagattacgccccaatttgatgcgcaaattaaaagtataattacgccccaaactggtgcgcaaattgataagaatataatttttatgattccatggggccatcataaagttattatggataaatgtaaagaggaccaacagagggcattgttttttgtacaaaatgcactggaaaataactggtccagagctgtgttgctaaattttcttgatacgaagctttttgatagacaaggaaaagcagttacaaattttgagtatacacttccatcggcacgaagtgatttagcacaggaactcacgaaagatccctacaattttgattttataacactgaccaagaactataatgaaaaagaattaaaagatgcattgatggataatattacagcatttttgttagaactcggaagtggatttgcttttgttgggcgtgaatatcggattcaaattggcaatacagaaaattttattgacatgctattttatcatatcaaattacattgctatgtagtagttgaggtaaagattacagcgtttgaaccatcttttacaggacagcttggaacatatgtggttgcagtcaaccatatcctaaaatcggagatggatgctccgactttagggttgttggtatgcaaatctaaagataatattcaggcgaaatatgcaatagaatccagtagccagccattgggaatatcagaatacgaactttcaaatttggtaccagatgactttaagggaacactgccaacgattgaggaaattgaagctgagctaaatgaacataaataggtagtattgattatgcggttctcaaggaggagtgtaaaaatggctagatatacagatgatgatatacgcaaagcatcaaaaattacatgtaagatggctggagaatatttaggcatatcttcgatggcggttagtattggtatgagaaacaatcttttaccaatagggtttgcgattcataatgaagagagggatcgatcatattcagaaagctggagctaccatattattggggaacgtttgatagcatataaatacggaaaaattacagaggttcaggttcaaggtatagagaagaatctacaaactattattgaacaatttcaggaaatgaagaatgatctggtttttatattaagcgaagacgcaaaataggagacattgatttgtttgaatatgcgttttcgctttttgcctatagtacaaaagaaggggaggtagatagtgatggagaatacgataaagattaatagacagaaattgtatgatgaaatatgggaaatatctgcctccggtgtagcaaagcaatatggattaaattatgctaaactgctacaaagctgtaaagattatgaaatcccgatcccaccatcggggtattggacaaaaatagcttgtggaaaagaggtaagtaaggcacccttgccaaaatctgatatagatgagatagaagtgctaaagcaaggagtatcacggaaagaaaaacgtcaactggaacctacagagaaaattattaaagaatctgacgaaaaatcagaaaacaataaaagtgagaagattaaggccattgaacaaataaaagaatatgaattggaagtattgccagatgtattgaattttttagatgatgaggaacggacaaaggttatagaaatagctaaagcattaacggtacaaagcaattcgcgtccacatcctaaattggttgcttatcgtaagaaaatatctgattggaaaaaacaggaagcagacagaagagggagatatcattctagtcgagatgatatacccttatttgtaaatgatgtttcggaaagttcgatgggaagaatttatgattttatgaatgccctttttcaagcagtcgaacagcttgggggagttatctatgaagatttaactgttaaaattcgagaggataaggtgcggtttaaaatagtggaatccatggataaagttcctcatcaaatgacaaaacaagaggctagggatttgttgatttataaagatgcgcaaaagcagcaccgatgggcatctgagcctaaaataccgaaaactgataatgtatataatgggaaaattcggattgttttttcagatggtaaatattttaaagacagtacaaagacaagcttagagagccaaataggggaagttttgatttatatgtatcaattatcggaaggtttgcgtttggagcgtgtaaagcgggaagaagaacataaattatgggtagagaaacaaaggctagccgaggaacgtaagcagagacttgaagatgaaaaaagaaatactagggttcttctaaatcgggcaagtgattatgagatggcctgcaagattagaacatacataagtgctgtcacacagtctcagccgcttacagaagaaatgattaaatggattaaatgggcttcggataaagccgattggtttgatcctatcattagtcgtgaggacgaattctttgggaaaagagaacatgataaagcggatgaggacaagaatatattaaataaaagtcgctatggatattagctgtgataggataaatttatatatgtaaggagcggtatgttatgaaattaaaaagaatacaagtaagcaattataaacaattagatagtgttacattattgtttgaaaaagatgttactgtattagctggcccaaataatagcggtaaaaccacgtttatctcattagtcaaaggagttttaaacgatggaaaactcaaatatacatatactgatattcctgttgaacaagctactgaatggcaaaaaaatatgtttcttgtatgtgataaatgcttttctgccagtgatgaggataatcaagtagtcgaaaatattatggctgagattacttacaatggagaactaaaattggagtattttattaatccatgcgaaataaaaattgaagttgattatgatcctcagtacgatgatattagaaattttgcagaatatattatggatttggacgaaacacagcattcattctattttgtatatactttcatgctaaatttatcatctttaagaaagacacttcttttgaattatgaaaaatttagcgctcgatttgtgagctatttagaaaaaaaggatgaacaaaaggcagatattataaaaagtttattaattgaagcttattcaaactgtttggtagaaagttgctttttcacagattccaattatgaaaatagatgtaaaatggaaacggcagaatttaaaaggctgttcaattttaaatgtataaatgcagcaaggcaattagatgatacggatacagattcttcgaaaacattaagtaaaagtattgtttcactggcgagtaaagataaaaattggaaagctgctactaagtcattaccagaaaacttacttagaaatattcaggattcaggcgtaaaagaaaaagttagacaagcatctgtagaaacattaggctcagcattaaagtctttagcacaaaccaatggtggtcatattggcgatataatgttggaaatggatgttacggaagatgatgtgagcgatttaatcaaaaagataacttgcgctaaatatcaattggatggtcatatgcttaacgaatcttctcagggtttaggatatagtaatatgatatatctgcatatgcagttagaagagtttaagaaagacatgaatccattgttggtgaatgtgttttttatagaagagccagaatcacatatgcatccacagatgcaaagcgtttttataaagtatttattaacagtatataacaaaattggattacaaggattggtcaccactcactcaaatgaaatggtaagggtggctggattagaacatttgcgtgttattagagaaacgcagatatttaaaagtgaaatttttgatttatcggcctttcgtagttcttttatagataagagtctaaaggaagaaacgggaattagtatgacagattcatctattttagaaaatttttttgattggttttttgaaataggattttctgaaataatttttgcggataaggcggtactttatgagggagatagcgaacggttatatctgaagaaattaataactcttccaacttatcaaaaattaaatggacagtatatagcattcattcaggtaggtggagcttacgcgtataattatagatgtctaattgaatttttaaagattaaaacattgataattactgatttagattataagaaatcggcattgacaagtagtgatatactaatttcaaaatcaactaattcaacgattaataatttctatagaatatcaaatggggaagctattaatttatacgagagttttgatgatgaggaggaatgtcaagaattgccatcaattaaggaactatacgagtggaaagataaaggacaaaatatattatgtaataatttgatttgcgttacatttcaagaaaaaggatactatgctagaacgcttgaagaggcaatgttgtccaaacttctgtcagtaaatgcttttgataaaaagttgagaagtgagtggaaaaggatcagaaaagagtctagactcaggtttactattcctaataacaggaaaggcgagaaagatagtgaattttccttaagagatatattagatagtatgtcaaacaccaaaactgattttatgtattctgttattttaaattcattgggagagacaatgttgccacaatacattgaggagggattaaaatggttgatgcagggttaaaaagaacagaaaatatttttcttgttaatgcacctgccggaagcggtaaaacaacaaaaatcaaagcaatgttgtctgaaattgtaaccactaatcctaatgatcatatactttgtatcacatatactaatcgtgcggctgaggaattatcaaaaggaatggatactggaaatatttttttcggaacaatacatgcatatattcataagctggtagccccattttttgcccacaaacaaattcttaatttgttttgggaaatctatggtgctcaaatacgtgagcgaatttcaaatactacatgcgatgataacataactatgagtaatcaaagatatatagaaaaatatggagcactaactgaagagtctgtaaggtataatatcctaagaatcaactataatgaaacgtcttttaattcattatattatggtggcttaggacatgatgatttaataatatttgctaaagaaattttcgaaagatttcctgctgttcgaagaaaaattataaataagtataagtttatattcattgatgagtatcaagatacatcaggatatatattaagacttttttatgatgctgttcgcgacacggagatcaaactctatcttcttggcgatcggatgcagcaaatttataagaattatgatggttcttttgaagaagaactactgatttttaatagatcaatttcattggataccaatcatcgttctataaaagtgattgttgatatactgaataatatatataataatccggcttatagacaagatgtatcttcagataagaaggaaatacaaccagattatttacctgaagttgttattacaaaagatgcaaagagctctgtaaaagagtaccaactaaaaaacaacgaagttctagtgctatatttactaaataaggataaatttaaggaaataggggcgagtggcttatataaggcttttagtggaatggataaatattccttttctaaaaagtatcatccaaatgatgtactttctgataatacaaaagaaaatcctgatccattaatgcgatttttattttcttttgatgatattatgtattattaccaaaacaagaattttggaagaatgattacacattgtaagaactataaagagttttattcagctagtacatatttcattacgaaacatgatgataaaaagcgtttggcaactatatatgaaagattatctgcaatttattttaataaaggaagtattgttactatcgaacaaatgcttaagattctgcttgaacacgatattatatcagagatgtttatagagggggttattgaggctggggaatatacagcggtattagaagtagcgataacagaagtaagaagattagcagcttatttaaaggagcctaaaatatctacccaacatggcgttaagggagaaagtcatacgtcagtggtatttgttgcagcagatagctataataccccaatcgttcatatgtatgaattctttagagtttggtcccatgtacatttttcgttaaatgaaatagaaaatttttattaccaatatgctaaacaggtaattgaagtagaaaataaattgggcatgccaacgaaagatttaacagctgattcacataataagaatgaggctaataagattattttgaaacaagcatccgaaaaaatattgaatgtatttcaggagaataatatctttgaggtgctatgcaaaaagaactatgaggagtatttaaaaaagcctaatgttggaaatgcaaagaagtgttttaaagacaatacggtatatggtgttgtagtagcgtacaaattgttttacgtaggatgttcccgagctagaaaaaatttaacggtcatagttgaggaagaaaaaattgcggattttagagaagattttataaagaaaatgaaggatattgggttttctgttaaacaataggacataagtacagtttaaacttaaatattcttaacaaataatgagttgataaggttataggcaaagtcatgaaggacaaatatagaacacagtgattatagaaaacaaacgtttgaaaatattgaatcaaagaacaatgaagtgttaaataaatttctattcgtggtgttagaaaatccccgccaagggtggatcatgttttcaagacatcattattatacactcaacaaactgcgaagtttgcgtggaattgtgccgaaattaaataataaatgcatggcatggcgatatgtaaaaaacgttttttgaatttagagggaatgtgtatagaatgccggaggacataaattggaagtttgaattataggttgagaaaactatttattgaggaaaataaaatatggcgaacaagaaaaaagagattacaatacacagctcagccgcagagtatctaatatatgtggcatctacaggtaatagctcagatagtcttgagatgcgctatgaggacgagaacatctggctgacgcagaaaatgatggcaaccttatatgatgtttcggtttcggcaatcaatcagcaccttaaaaggatatttgaagataatgagctggtcgaggaatcagttattaagaaatacttaataactgcctcagatggtaaatcctacagtacgaaacattataacttacaggcaatcattgcagttggctttaaagttaacaatgagcgcgctgtaagattccgcaaatgggcagggcagattgtcaaggattatacgattcaaggctggacgatggacaaagagcgcctgaaaaaagggcatatgttcaccgatgaatattttgaacgtcagctgcaaaatattcgtgagatacgtctgtccgaacgcaagttttatcaaaaggttacggatctttatgccacagcgtttgattacgacaaggaagctaagactacccggcagtttttcaaaatggtccaaaataaaatgcactgggcagtacaccggcatacggcagcagaattgattgtagagcgtgcaaatgctgaaaaagaacatatgggactgacaacatgggaatcagcgccggatgggaaaatcgtcaaagcagatgttgttgttgctaaaaactatctgagcgagaaggaaatgtcctatttagagagaatcgtttcactgtatctcgattatgcggagttgcaagcagaacgaagaataccgatgagtatggaggactgggcaaagcgtcttgacggattcctggagtttaatgggaacgaattgctgatgggaccgggaaaagtaagcgcggaacaggcgaagcttcatgcagagacggagtttgaaaaatatcgtattgtacaggatcgattatttatgtcagactatgataaatatttgttggaattagaacatcaagcggatcaaaatgacgcgtaaagaggattatttagttcccgcttggggagaattatgccatcccgtcgtcattattatccactcaacaaatatcgaggtagcaataataatgcggaataaacgataaaatgttacgcttattgtagtggcaggtaaacaaccgtactttattgaaaacgtaagggttcatgatggtttgaatatcccagtgtcccaggtacataacggctttgaaaagggagagacgtcgtagagatagtagcagaagcgcataggattgagaaagggatgatattgtgggaggaaaagaggcattacgaggatttatatatcaagggtttgctaccgttcttgaggctttatgccatgaaggctgggatagaatttatattgagttagattctaaaaatgataaggtcgacattgcgttagaggcaaatcttgtaatcgtcaaaagcattcaagttaagtcaacgatcaatacttttaacaaaagcgcaataaaaaaatggttaatagatctgatttatgataatgtgggggcaacgagttttgaactttatttaattggtcaatgcgatgaggcgacacgaacctttattaattctatagacaaacttcagcatggacagttggatacaaaagcgcaagattctctgaagggatttgatgtcaatatagtgaaaggaagagaaatcacattttcacatctgccttgcgatactgaggcactgcaaaaaattgtgatagcctctttgtttaagtatatttcacttagacattatgcgagttcatatgaacaggtacggttcattgcgttagcaatggaaagtgatcaattgatttcttccacgcatgggaaaggtgtttcaaggaaagaatttgatgaagaattagataagcgcgtcattcttcttgccgatcagtacatccccgaaagaatatcgatcgggattgtaagtttctcttctagcgaaataaaattggaggaagaagcggaaagctgtttatcattgactgataattttaaagaccgtgagtttaaagaaaacctcgattggaatagggacatttatgaaaaattggaatcgtttttacgaaccaatacagataagaaacatgcctatcaattatttttagttacacattgtagcattgcttttgctgctggcagaatactgaacagtaaggtggggattaatatctttccggtacaaaaaacatctgctcatggaactgtactatggaatgtgaagctcgcaccgggaagaaaatatccgaattggaaaatttcagattcaggtcctgttgaaaataagtatgatacagcgctaatattaaacgttactcgaaacatacgtaattacgtgataaattatgttgaggaaagtcatataccgatcgggcgtttgattgactgcacgttggaggaaaatggcgccaccaatttttcggtacaagatggcacacatgccgccctcttggctaattcaatttatgaagcgattggcggacggaatctggcagagcgtcgggcagtcttacatatatttgcgtctgcaccaaatgcgttgatgttttttctgggtcaaaattcaatggggtttggcaaatgtattttatatgaatatgattttgagcagaggaatagttgtacctattccccatcattctactttacgaattaataggtgtggtgatattacgatatttgagaaaaggcggattttgcagatattggaatagagtatcttacatgtgtgcatcattatcacccactcaacaaatgtcgaggtggtaataatgatgcggaattgtactccagaaggaaaatgaagaggctaaaccacaagatgtagtggtttttgacggaaaatcgaggaaaaaatcggccccccaatggccgttttgcccctgatttttttcgccttttcatagatgtgagacaggaaaaagaggatatgagataaaatttcaggtcagccagatcaaaaaatagctggccttttttaatagagtatccaaaatagaaacggctaaatgtgaaaggacagagcgaggagtttagatgtttaagacttatttgcgccggacagcaagccctggtatagggattgctctttctctgccggctcaccaggaggcggtaaaggatgcgtttccgagggcaaggctaaaggatggggaaccttatcttttggaccgcggagggtactggccgagagtgatcgaatcggttctggagcgttataatcatacactggaggaattaaatctgttagcttataagccgtcaaaacgtcaaaaatgacagagtggcagatcggggtttatggaggaattggaagccctctgtgacgaaatctgtattttgaaaaggggtaaaaccgtgttttacggaactgtggaacaggcaaaatctaaaagcggctgtgaaaaaattgaggatgcatacttaaaattttctgctgctgatgagggaatcggcgcatgaaaattttacaaagcttttaaaacataaatgcgaattctaccagcggttttgaattgattttcaagccacttttttctttttataaactaaggctccagccaaacagtttgcgagcctgagtatcagatttctccaacagaaataaaaatggaaattatgtgtatcttaggaaataattaatcatttatccattatatataaacacattagtgttatggatccggtataatgtatatgatttaatctgaaaggggtgtcatgctttgcttgaaaaaatacttgttgttgatgatgagaaagaaattgcggatctgatcgaagtgtatcttcaaaatgaaaatatggatgtgtataagttttattcaggggaggaagcgcttgtctgtattgggagtacagactttgatctggctatattggatattatgcttccggatatcagcggactttcgatatgccagtccatacgaagcaaggagtacacatatccggtaatcatgctttcggcaaaggacggggagacggataaaattaccgggcttacactcggcgcagatgattatataacaaaaccatttctgccccttgaactggtagcgagggtaaaggcccagcttcgccgttacaagaaatataatgtaggcgcagcggttccggcagcggatgaagtctttcaatatgccggattgacgatgaacattaagacatatgaatgccggcttaatggagaggcgttgtcactgactcctacggaattctccatattaaggattcttttagagcgcagatgcagtgttgtcagtgccgaagaattattccatgaaatctggcaggaagaatattataacaagagtaataatacgattaccgtacacatccgccatctccgtgagaagatgaaggataccggggaaaatcccagatatataaaaacggtatggggggttggatataaaattggggagatataaaaaaccaaagtataactattcaaagctgggccgtattacgtttatccgaggattgttgattacagtgggagcagttgctgcagtctttggtctgcggatgctgacgcgcggacacttagcagatgccattgttgggtggattgcacgcagcccttcaatcagtgaacaggaagctgatttgatatatttcaggatagtgactgccaatatgcagtttattcttacattgatcataatcatatttgtatttttgctgtttcatatgctgttggacacatataaacgatattttgatgaagtagtaacagggattgacaagcttatggaagaaagagcagcgatttccctgtctccggaactggagagtgtggagcataaattggccgatgtaaagcggacacttgcagaacgggcggataaggctaagagggcagagcagcagaagaatgatctggtagtatacctggcccatgatatcaagaccccactgacatctgtgatcggatatctcagccttttagatgaaacaccggatatgcccgatgaggagaaagcaaaatatatccatactgcatgggaaaaggcgaaccggctcaggacgctggtgaatgagttttttgagattacccgcagccactcagaatctcttccgcttcataagacaaaggttgatcttttctatatgattgctcagatttccgatgagttgtatccgcagttgaatgcatgtggaaaaatcatagagaaccatgtagatgaggacatatctgtatatggagactctgataagctggcaagagtgtttaataatatcctgaaaaatgccatttcttatagtgcggaaaacagcgttatcaaagtatcagccagagagctttcagaatggacggtgattcaatttgaaaatgatggggaaattccggaggataagcttaatgtaatttttgataaattctgccgtttaagtagtgccagattaagcgaaacaggaggctccggcttggggcttgcgattgcaaaaaatattattgtactgcacggcggacagataaaggctgaaagcggtaatggacgcactgctttcatcattgaaatcccatcagcgtcgtcccaaatccctgttacagcatcttagaaaaaagtcatcttttaagtatagggtaatatctgaatagatttttgattatctctttatttcttcttaaataccggtatagcccgtaactccgggctttcccggcttactgtgtattggaagaatctcacatatacccccataaccgctcatgtctttgctctgaaaagtagtagattgagtagtaaaacacaatcttactactatgctgcaacgtccattccagtgtccaggcggtccatttctgccttggccgaatcgaaattggcgtgggcataatagttgagcgtcatgacgatgtttgcgtgacccatgatgtattgcagcgccttggggttcatgcctgcattggctttcttcgtgcagaatgtatgtctcatggtgtgaggggtcattaccttcggcagcggtgcctcatggtacttgttgtacttcttcaacaggcacttgaacatggcatcgtagtttgccgccgtttttggcaggccgtcccggttcaggaacagaaaatgcgcgtatccatcaatgataataggtttagcacccttgcggttcttcaggacacgcttgaacgcttcgctggcggctgcggtcattggtatttgcctgttgccgctttccgtcttgggtgtctcaatgtagaagccgtcctctgcgctccgtaaaagctgatgatctactttgacatagcctttttcaaaatctaagtcggtatcggtcagcccgcaaagctcggagacacgaagccctgtttccagcaggataacgatctcgtcgtaatacttctgatagaccttatcctcctgtatgaagttcaggagttctttttcctgctccggggagagcggcaccttgagttccgtgtcatcgttcaatacctcgttgatgttgaaatcaaacggatttttacgcagacagtcgtcttggaccgctaggaaaaaggcagctttcagggaacgcttgtgattgctaatagtattgaaggcaatccctttttcctgcatacgcagcgcccattctttagcgtcggacagcttcacattttcaatgctggccgcccccagcttatcctcagaaagaaggttcatgagctgtttgcgtccttttttggttcccctcttcacgtttccccgttgccggatatacttggcataaagctggcagaccgtcattttcttgccgatggtgtctatgccgtcgtcaaggtccttctgtatctgcttaattttttcacgaagtgaaaggtcagcccgttttccggcaggaattttgtccgtggggaccagcttccatgagtaaacaaatttcggttctccaaaagcgttagtatatttatattggtatcttccatctggtcgctggctctctccagactgcaaaatacggtttttgctgtctcgtcttttctctgacatattcgtcatgctcctttcatgacggatagagcctttgatatgctacaaagattatagcacatgcaaggcccgtctgcatttatatcacgtccagtccatctattattttttcaaagtgcttccgtttaatctgaatccggtttccgttcagaatgacccagccagcacttggattttcttcagcaagtttgcgcagcttattttcgccaatgcgaaagtattttgacgcttcttcaatcgtcaatgtatatttctcccagatgggtacatcagtattcataatgtagcctccttcagaaaaagagaaagccgcactgatatggtcagagccgtcgtaacataacggcacaagtcggtgcggctgcctttgttctatatgaaaaatttattctcgctgtatttgccacgccccccagcggtgcgccggaattggcgcaaggggatattgcaggccgcctctggcgaggctgtcataactccacagcgtcgtttgtaacgtgcgccgcagggttcccccaaagtctttagggagccgtgaggaagtgtcattatcccccgcgctgtcatcgcgcccggtgtgcctcaccgggtctaaggcttacgttgatcgctcgaacagcttgtccttcacctccttaaagctgttgtcctggcgtcgtgccttatgccgctatcacgcgggttttgtgcctgcaataccgtatattcagttgtcatggttcagggaagaactgggaaagcatgtccttcacccttcacgtttttgcaggcggtttcgcaccctgttttcccttattaccaaaatttttttgaagtttttttctggccttgataatagacttggagacattctggtgggtcacgccctccatagcagcgatagcctcgacgctcattccctccacacagagcagccacagacgacggtactgttttggtgtcaggcagcttcggatctggaccatcagaagggcgcaggttctggcgcgttccgcgtccgcttcagcctcggccagcttctggaacagcttgtcctccacagatgggacggatacaataaggtccaggtactcgtccgccagggggaggccgttgtcatagtagctgcgtcctgatttttccgtcgtgtgatagtcgctgtctgaccaatgtcgatgaaaaaagcgccgtaactctcccaatgagagctgcggcactttgctggtgattctgattttcttgtatcgtttgaccctttccatctgtcattccccaccttgcagggaatggcataagtgtccttaattggcacattacccctttttgcttgatagggacaagtataaagggggaaaaagtcaagttacggttagtacagggtcaaaacacggtttgtttctgacgatagatgacatgatttttactttttcttaaaacgatagcctacctcccggacggcttctatcggatcggtgtcacccagctttttccgaaggcgtttcatttcacatacaacgctatttttattgcccatgtacggttcggcccacacctgttcgtagagctgttcaaaggtatatacgcgctccgggtggctcataaacaggttgagtaattcgtattcccggtaggtcagttccagcggtcgtccacttatcagagcttgccgggtatgtcgttttattatcaggtcgtcatgggctacaatggaatagacccgcgtttttaggtggttcagatcacagaaacggcgcagaagggcatagacacgagctagacattcctcagtttcaaaaggctttgtcagatagtcgtcagctcctactttgaatgcctccaatttgtccgccaacgccgatgatgtggaaagaatcaagataggcatgggctttaagtctcgcagggtctttagcagttccatgccgtcattttcggggaaacaggcgttgagaataactaaatcgtattctttactcgccagctccgtcagcccttcccggacagtcagggtataatactcatctgtcatttcgctgtctacgttgtacttaatgtccttgcaggtctgtaaatcatggtcgatgattaaaactctgttttttcgcattcttaccccttccccggaaaagacgtggccagtaaatacttagatttcttaccttgtcacaacatatccgaatattatcccatagaagttttgtcattacgaatagaaaagcttgcgatagaggcgattacagccaaaaccatattgattgcccacaacggtgaatatcccatattcatttttacaaggatgccaccaagatatgaacttgcaaaagccccaatttgatgtccgattaaggtaaaaccgtacagaacggccatcttctctgcgccaaacttacggctgatgatacctgatgtaggtggtactgttgcgtcgccgctcattcccagaagcgttgtagcaaggaacgcaaatggtactgttttgggcaaaatcaaaaaccccaaagaaattaatatcctcatggcataaacacatccgagaatgtttttcatgcgaaatttcgcgccgagaaaaccgacaaacaccgcacctgtcattgtggcaattccataaatggtaagtgttaaagacgccgttttcccagaaataccataggacaagtattgtgaaaacaagtggctttcaatgatggacatattgaaaccacaggtggcaaatccaatcagaatcaatcggtaatctctgtctgcaaaggcaactttcaaaatagaagaaagagattgattacctattgtctttttatctcttgaaacaatcgtacagtccctactttttttgcccaaccagaaagcaactggaaccattataaaaaaagggagggttgtaattgtcatcgcggcgcgaattccaaagccagaaattatcctttccaacccaggagacatcagtgcgtcgccaattcctgcgcttgcttgcacaattcctgatacaatagctgcccgacgttccccaaggactggcgtgattgcacccatgacaattccgaaacaaagccctgttgtcccaaacggcaaaaccaagccaaagaatataaacaatgtaaatatgttccggcacagcggtgtaatcaccaaaccaacgatggtagataatatccctatgaaaattacgaaaacatttgatttccgaagcgcaagcattccgagaaatggttgtgcgaatccataaaccaatgctcctgcaccaatacaaaaactgataccggcataatcgacattggttacggggagaaggccattcaacataatcccgtaattatcatgtactccttgcataactccgtgaacaaggcacgcagcagctaccgcaacgattagctgaataatatttaattttttttgctgtaaattagactgctccattgacactgacttcccttttcaatattttttcataggcatatttttcattgttgtcaaaccatatagttccgcagtagttaaaaccattttttgatagaacatgcctcataattgtattattttcatcagtatcgacccgaacgctgtaaattcctttttgaatacacagtttttcagtcagccgaaacgcaatacttgctataccttgcccccggtactctccacatattgccatacgatgaactactgcataaggaagatcacttttccatttaccttgtagagtttcataagatacttctcccgcaaaatcaatgcagagatatgctgcgattttagaaccgtctacaataaaatatccccgcccatgcgatatatccttaccaatggttttcatatctggatatccagtctgccactgatcaatcccctgcgttttcagaaactttttcgcttcgtcgattaacgccattgctgtttcagcgtcttttctatccgctggttgtaaaaaaaaacgttccataaatagtacctccatcttttagtttttgaatctcttgaattttatttctgcaaagccatgtgaaaaggaaacaacataacttactgtaaatgtgatgataatggttcctatttgtatcttgccgcccaccaaaaacatcgtgataaatccaactgcttcaattattaatcgtgattttttgatgtccaaagagaagacctgctttattgccagcatcataccgtctattggcatccttgggtagtctgttgcaatataaataccggtcgaaatacccataatggcatatccgattaaaaaccataaaaaacacattcctgttaaattattaaataatcttgcaccaattactgcttttgccacatccagagaaagtcctttccatataatcggaaggatacaatccatctctactttacggttaaagactgaagtgataatccaaaaacttccttgtagaaggactgtccaagttccaagcgtaataggggttaagtctgccaatcttacaattactgtattccaagcatcaacgccaaaaccacttcgcaccataattgtaactccaacacttgtgcagcttaaaccggcaaaataaatacaattcaaagagagttgtctgcataaacttttgaattgttgagtttttatattttttaacaagttctacttgccctcctttctctcgtctgttataataacacacaataacacagcaaacaaattgaaatatttatagttatagtttaataattttgaattgttggaggaaatctatggatctaaaatatttaagaacctttcgcacaattattgatgaaggcggtttttcaaaagctgctgaaaagctgaattatacacaatctacaattacatttcaaatgaatcaacttgaacgcgacttgtccacaattttatttgagaaaattggtaggaaaatggttttaacaaaggcgggagaacatttgattccctatgtagatgaaattctccaatctgtggataagttgtcctttttagacgaacatttatcagaatgtcagggagatatacagattggtgttggcgaaagtttgctttgctacaagctccccgtcattttgaaggaatttcataagcaagcgccgaaagctcgtttgttcctgcgctctatgaattgttatgatatccgtaacgagcttattagcggaggtttggatttaggcgtgttttatgaagatgtaggaggctttggatcgaatcttattagtaaacatttgggtgattatccagtagtattggtagcatctcccaaaataaaaagcagttatccggatttcgtaacacctgacagaacaattccgatccctctcatcatcaatgaaccgaattgcatatttagacagatttttgaacaatattgccgtgataaatcaatcattcttgaccatacgattgagttgtggagtattccaacaatcaaaaatcttgttaaaaatgatgtgggtatttcttttcttcccgaatttacagtaaaagaggaattaagtcgtggtgaattggagaaaataccaaccgatatttcgggtacaaaaattactgctatttgcgcacaccataaaaacaaatggattagcccactcatgcagctgtttctaaatttgtgtgattcgctgacctgtgacacgggacggtaaagtgccattcttcggttcctgctgtggcatacttccctcaacatagaatacaccattttccatattctcaatgcggagggcgctttcttatcaaccaaaaattctttgatttacagaggatgattaaacggcaagcaatgcctgtgttaatacacacaggccccagcgcggttatcaccgccctggctacttgttgagggcagcgcccccaagcccccttgaacagctccgtgccggagctggctgcgcgtcctgcggacgcttaatcgggcgctgcccgatggagtagcacagagcggaaaccgcatcaagagcaggccgcctgcggcggtgcttcgcactcttgacccggccccgctccgcgcaagtgcggcagtcaagggggaaaatcttatcaggctttcccccaggtaaagccacgatgggagaacgtcaccggcccttggactgttcctgtttctcctttgtttcctgttccttctcctggtcctcatagcccatgagccggtccacattggccttgaccgtcagcagttccttcatctcgtcgcgggccttccggtactcgccataagccgctttcttctctgacagtagcgcggcatattctgtctgcaagctcctcaccgtggggagctttttcacgcccaaatcatcaaaggctttcttcgccgccttgtgcagcagaatctcggattcatgctcggcaaggaacttcttggagtaaccggccttcctgtatgcggcatagacttcacgggtcttggagtaattgatgatgtgggtttttaggacggtaatctccgcaaggcgctgttccgccgtcttgatctggccggacagctcgttataccgagccgtggccgccgccgttttctccttcagcttcccatattccagcaggccatgctcggtgaggaagtttaacgtctgcgccatctgctttagattgaaggacctggcccaccgctcatacccggctcccttgcctgccttcagcttggcctgaatatccactagcagattgacgcagggcggttccggtgcaggccgttctgctttcttcctgggcgtgtgttccttctccccggagaggacggcccgcagctccggctcatcatagccatcgcccagactgtccatgcgggccacattcttccagcccggagctttgagacggagggctttcccacggcgggatacctccacgcctgcctcctgcaagagctttaagagggcctcaaagtcggcaggcttttttgccagggcctcgtcaatggccgtgcgtaaaagctcccgctggcagggcttggcggcatcgcccagccacttgttgtaggtctttccatgacgcttcgggttctccacaatggagaagccgttctcaacacagagggtgtcagagagccgacgcacggccctggtgctgccccagaaattgcggaacttccgcttacagtccagggcggtggagttccagatgatgtgattatggatatgcgccttgtcgatgtgggtgcagacaatgaaggcatgattgttcttcgtgaaccgcttggcaaactccacgccgatgcggttggcttcctccggggtaatctcgccgggaacaaaggactggcggacatggtaagcaatcacatcgtcctcgccccgcgtcctgccggtgagcgcggtatactgccgcttggagagtaggaactccgcgtcagccacacggctgtcacactgccagccggtaatgagcctgccgttgtctgttttttgcgggttctttacatagtccagaatatcggcgattgccgttcccaccgtccgtcccttgccggtatgcaggggcatgagccgtgtggtcgccatcggtaaaacctcccttccaaaaagaataggagcgtgaagtttccctcacgctccgaacggttgccttatccatatatcctgccctgaatggcataccgtaaatcctgaatcttgcctaacagccacgccgccgccatcgggaggcccatcggactgataaggaaggcaatcaccagaagaatgatcccgttttgcggggaataggtgacaagcaccgccacgcccaggattgccacgatggttccggcaaggccgaaaagaaatgcggagcagtaaagcaggcccgcgcaaatccaaatgaacagggccagggccgccaccacgggagcggctaaaattttaagtatcagcttcatgttgttgcctccttctgtcacggcggtttgccgtctttttttctatctttagaatactgtatcgggccggaaaacacaacgatgccgccagccgggaacttcgccgaaaatttcggctaagttccagagacagtaaaaaagcggaggacggcaggccggtcatggcgcgccgtcctccgcagggttcacttgatggccgccagcgaggtgagtatctggttggccgcctcccacagccgctcatagctctggcgcatatcctctaaatcggtgtcatagaggcggcccgtctcatgggcgtggcgggtgagctggtttaagttgttgctggaatagcgtaagagagaaatcatttccctcagctccggcagctccagcttcaccacaaggccgtctatcgccatcttgcgcaggtaagcgctcaggttatcggttccgagttgggccattttttcctcaatcagctccttttcctgtttcgatacccagaacaggaggggaacatcgcgttttcgttttgccatcgtcaccgctcctgcactttctttttgccgggggcggcaggctttggggcatcaggctttttctggagcttatcccggacagaggcccttctggggcggagaggctggtccgggttttcgtccctggcaataaacgcaaatacgccggggcgatccttgagtgtggagagggacagcgacgggaacggcagcatcttcatcagccgcccctggtctttggaccctgcacgggcaagaaaatccgccgagagctgcaccatgaactgggtcccttccgggctgtttggttcccgctgtccctgaaagctgcgcagaacacgcccggcctcctgcataatgtcctctttcgtcagcggctgggtgagaaggaagtcatgccgggccattttgaggaacaggtctgtcaggccggggttgcattggtccaccacaaaataacggctgcggttctggttccagtcgtctatatcctccacaacggggaccgtcctgacccattccttattggaacgggaaatgcgcccgtccgattccttatcccggaccgtggcggcgagaacgtaaaatgtccggtcatagccgaactgttccaccacctgcgccacggacgcttcgcccagccggttgtctccgtaatgctccgcaatcgcggcctcaatcgcctctttgcaggcgacattggccttgtgggaggcgcggtatgcctccagctcgtcatgagcctgcgcataagtaaccgggtgctgatagattggcagttcccgctgggcctttagcatatggtcggcccggctttccaggcagtcgcggatcgtgtccatatagtccgtttccacttttacatactcctgatacagatcgtccagcggggacggggaatccagcagtaccgtcgcctggccgtggcttaaatccaggttctccatcgccatcaccatgtcctcccggacggtgtattcataggcatggttcaggatttcctccgggggctgcgtaagcagccagtcccggaacttcccctgttcggcggacatcttttcatataacgcggtattcatttcttcgttgctcattatcgtacctcctgttcgtgttgtttggatttccggtcagcggtccttggcggcagcggcctctttaggccctccagcacagaggtccgttccttcttggccggggtccgcgccgtctgctggccgggtgcgttggtgtccagatccagccgggcattcaactcggcaaggcgggcgctcttttctgcaagttccagctcctgggggaagggtttgcctaattccgctttcgcggcctccacctgtttatccaggttagcaagtcggtcctgcacggcagccaggcgctccggcattccggccagagcgttgtcgatacgggttaggttgcctctggcgtcctggcccagcgtgacgcggtgggtcatctgcccctttaaggtgaggacaaaatcgtggccgaaattctccaccgtcagggacatgtcaaagccccggtaagtgccgatggaaagcggctgggtccccttgatttccttgcaggccgccaggattgcagcgcccgcgttgtccttttcggtgagggtgtcgccccgcaccaccattccggcaaagccgtccttggggtgggggtgggccgccagcgtcgccatgtctgccgtaaagccggtgacatagcccttattctgttctatctgttctggaaagtgtttcagcaggtcgtcctccagccggtattgctggctctgatggttagcctttaagagacgcaggcgggaaacgtccacatctaagtccattttctccttgataagcgggttgcccgcgcacagggccttaatctccgcataagagagggccgtctcgtccacgtcctcacaggagcgaaccggcgatttacttgtcatgatctggctgatgaatttctgcttgttctccacggtctgccacagatagctgtcaaaggtcccctccgtgacataacggtagatgtgtactttcttgttcttgtttccctgacggacaatacggcccttgcgcagttccaagtcaccgggccgccaggggcagtccaagtcatgcagcgcaacgagccggtcctggacgttcatgcccgcgcccatcttctgtgtgctgcccatgaggacgcgcacctggccggagcggactttggaaaacagctctttttttcttgcgtcggtgtcggcgtcgtgaatgaaagcgatctggctggccggaatcccccgtgcgatgagcttatcccgaatgtcctcgtagatggaaaagggcgggtccggctttacgtccaggagattgtccagggcatgaagctccgtgccgcccgctgtcttgtccccggcagtccgcgccgccttttcctgttttgcggcggtttttcctttgggggtggacaggtcacagaataaaagctgggtgagcttttcaggctgtccctcctgccagatacgcacgatgttgtccacgcacaggttgactttgctctgcgggtcgtcggggagcatggggttgatgagccgctggtctaagcccagctttcgcccgtcgctggtgattttgagcatgttgtcggttcgggggtctacatgacccgcgtgtaccttggctgcgcgctcggacagctcctgcaccagcatctgctggtgttcggtgggctgggccacctcgttgtggaactccacctccgggacagggaggtttaactggtcggcggtcttaatgtccgccgtctccttaaacatgttcatcagctccggcaggttaaagaaacgagcgaaacgggtccgcgcccggtattttccttccggggccagctcaatggccgtcaccgtctccccgaaggtggaggcccagttatcaaaatgggccagaccctgcctgctgattaaatcgtgctgaaggtaacgctgcatggtgtaaagctccgtcatggagttggagacaggggtgccggtggcaaacaccacgcctttcccgcctgttacctcgtccaggtaacggcatttcagcagcatgtcgctggacttctgcgcgtcggaggtggaaaggcccgccagcgggcgctgccgtattccatgttcttgcgatatttcttggcgttcttgccctttaggtagactgtcagccgcaaagcggcggccagagccacgcccaggcagaggtctgccgggtggaagcttggaagaaaggactggaacgcggcagcaaatccgtccgtcaaatgcagcaccttggcggagaaatccgcccccggcgtcatgcgccatgcctcacccagcttggtggcaaacagggccgcgaacaggtacggaagattgagaaggacgagcttttttagattgatctgcttcatagctccagctccttccgtttctgccggtctgcgatgggctttttcaccatctccttgaacttcgcaagcttgcctaacacagattcccgccgttgggcctttttcagcttcgtgacggtgaacgcctcaaacgctttctgcatgttggcctcgcggggagccttgaagaacacttcaaatgtccccttgtcatttccaaagacggcgtactgcacatgatacttccgggcgatgcggtcaaactggcacaggctcttgtcgtgaatgtccagctcccgcatatcgccgtgctgccgttccagctcgtccttgctgattctgccgtagtgctgcacttccggcttatcccggcttttggcctgctttttctgtaccttctgcaccttcttttccttgcggtgggccaggtacttggtaagggccgctttcagcaggcggcccgtgaacttgctaccgctgataaccagcgtcatggtccggttctctatgtcctcctgcacctatcatcacactcctttccttggattgcaggggcggcgtccgctaaggcggcaccaccagacggcgcagcagacacttaatcgccatcgccgcgcccctggcccttcacggtcaggataccgtccagcgtggtggccgtgatccgcagccgctccgccgtggcgatgtcgttctttactgtctcgtccacggtgtccccgcagaccaccagcacatgggagcgccgcagatagtcccgcgccatgtcgataccgtccttatgctcctgggggattttgtccttcaaaaacaggggcaggaacagcagggggcagaccggcgagaagcccgaatcgtagacggcacggcagtaccgggcggcgttctcggtgttctcaaactcgttatcgccccagggggcggtgatgtatgctaaaggtcgtttcatggctttgtcctttctcccggtgtccgggcatgaaaaatagcggcccgtcagccgccgtgcatatcgtgatttaccagagcggagtaatagttcccgatggtggtgggagcattgaacaggaccgccagcaggtattgcctgatgttgcggaccctggtggtgttctgcttcagacagtcgaacacaaaccggatatgctcactgtccagctttaggagcctggactttaccacctgggcggggtagtcgctgccggagacgcggatctgctttcgtgtggagcagactgtctctaccatcagctctacgatctcatccagccggtcacagtcgtaaggcatatcctgacgtagaatctcatagctgatgttctcttttatcaaatcccggtataattccatctggtctgtgtccgtttcccttcggttcgcttccggcggtcctgccgccgtttccccggaagggaaaggaaatgaatcggtacttgataaatcagtaattgattttttagtaattgatttcttagtatttaattgcgttggatttcccgacgacggtttttccgtcatcggtttttccgttgtcgggttttccgacgacggctctggttcctctggacgctcatagatgatgtattcgttggaagaaaacttcccgctggcatcggtggtctgcctgcggcggatatacccggcagcctccagctcgttgagggcggagcggatcgcgtccttgctctcccggttgataacagacaggccggacagggtatagtcccagtcgtccggcagggacagcatctgtgacaacagccctttgcttttgagtgtcagccgcttgtctttcaggtgatagttgctcataaccgtgtagtcccgcgtccgttctactcggaaaactgccattgtccgtcacctcccgcgacgccgttttttcggcttgtcgggcaggatatggccctcaatgacagtggcatggcggcggattttgatatgtccgcgcttttgggcagccagggccttggcatatgcttcctctgtgacaaaggcacggatatagtcgcccttgtcgcccacaggggcctgccaggaaagcacatcaaactcaatcatgtgccgggtgtcgtccatgaagcgttccagggccatcaggtcatgccccttaacgccggggcggtcagggattgtcatgcaccatgccccctttcccgaatatccagaatgaccggcccgtagcggaccacaagcagggcattcaccacaagccggaacgccaccgcgtccaccacgccaggatcggcaaggtcggtaaaggtcaggccgtccgcgccggtgaacaagtccctggccgccacgaacagcgtgtagtcatggggtgcaataccccgcaggagtgcataggcaaactccaggccgcgtttacagaaacagttggcggtccgcctatgcaggtcctcattggccgtcagcagatacatggcggcgtagtacgcaggggtgtcccggtggcgtcggtagccctggcgggccttgaacgcctccatacggggcttatgcctggcatctgcccacatagtccccggaaagagccggatcaaggcggtgagacggggagccagggccgtatgatgggcgagggtattctgaaccgcgtcaccgtagccgaccactccggcctcaatgcgttccgcgaggaaaggacagcccttcacggtgcagcccagctttttgcggtattccgtgcagagcttgcagtccacgtcctccggtttgtatcggaatgtgttgatatacatggatttcctcctgtctgcggacatgaaaaagccgggcagagcatacctccgtccggtccgtgtccgtttcttatatttgattttaacgctcctggctgcgctggcgtttcttctgccacgcttccagcagcttgatgatggtttcctccatcttctgcggtgtgtagctcttgggaaaatacttcttgagtttgtcgccggtcagaaccaccctgtcctgctcggacttcttttcctccgacatgatggaccgtgacaattccacggtgagcgcaccttgctggctggcctttttcagccgctgggcctgggaaagagaaggcatgttctgcgagtagtccagcgcgtccagaaccagcatctgctcatccttggtgagataggccaactgataggccggggaaagggcaatctgcttctcatcgaccagctttaacagttgtgggagcaactcggtcagagaggcataattgcgcagcgtgtccccgctgatacccaaggattttcctatctcgtcgtcgctgcggaacttcgccgaaattttcggcgaagttaaatccgtccgtgcgccctggtgtttttcgacttccaggcgcatacggtaggcccaggcccgttcactgggaaggacatcttctcgctgaacattactatccaccatttcaatgacggcttcctcgtcgctcataccccggataatggcgggcatatctggcagctctgccagctcgctcccacggtggcggcggtggcccgcgataatctcatagccgccctccgggtcaggccggacaatggctggctggcggacgccgcgttcctttattcgcgccgcaatctgctgcatggaagggtcgtcgtcccttacctgatagggctgattccccggcatgacaccacgcagggctggatagcctttgaaagaatgtagctcggaaagaggcagccgcactacctgttcgtcctggggtggcgcggcaggtgtttcctgtgcttgctttttccccctctttttgggggcgttggtagttgtgtcactcatgttcgttcacctccttgggacgaaaaaaaggacgctcaacaatgaacgtcctggctattggatatttagttttcggtttgcttgtgttcacaggaattgtggtagcatatcaaggctcattccgtttgtagtaaattggtagtaaattcagcttgaaatcctgtgaacatgccgataaatcaaggggttggcgagacaatcatggtttttgaaataaactattaaaacctgtagatccgcatgagttggagaggtgtctctcatgattagtcataataatgctccgccatgcaaagcgcgttgtgtgataagcccggtaaaaaataagatgatacaatgtgaacatcaaatacgcatgggaaacaatcgaacaatccttaacttttatcagggaacacttaacagaagacatttacacggaggaactggcaaatatggccggcctgtccccgttctattttcagcgtttgttcaagcggcaggtaaataaaccggttcaggaatatgtgtagttccgccgcctggcaaaggtgattgagtttgacagccgtatccggtctgccgtgtctgtaacaaaaatttttggtagacaggcgaatgcggatcatggccagatcaccttaggaatttcttaatcattcatttaccattccatagaaaatcaattatctcaaattaaaaaactgcctgctcatcaatggtatgctgaaactgcctgatcgagcaggcaatatttatatgaaggaggtaattttagagtatggaggtggctatgagaaaaaagttaagacggatttttacaatactgggaacaacagcactgatttttaccataacagcttgcgggaaccgcatggatgccatgcagccggattcttcctatgttgcagacttttttgatattccggactcagtgacaggaatcgaaagacttctgctcagagatgatatggcttatatgtgctgtctggaggaagatggcacgtcctatctggcagcaatgaacattgatgacggcaaatttttgaaacagaatctggagctggacgcctcggtttcgcttctggattttggctttgccccggacagcagtatctgggcggtttgcctggaacaggccggtgtctatcgtttaaggaaatttgacaacagcggttcacaggttcagtcggttgacctggcaggtgtgatggagacctcagtcatatcggcagttggaagagatttgttcctcagtattgataaagagggaaatatctgtgtggctgctaaaggcggaaatacgttggtctatctgttcgaccataacggcagtttcttattttctctcgactatgagggaaatcttatgacatccacaacgactgccgggggacagattggtatttgtgcgacttccccggaccgtatgaactatgacctgctgacagtggacatgaagagccgggattggagtaacgacaaaatctatctgggcgcaacagcagggctgtatggaggtgtgaacaaagatttctatcggtttgattcttccgttttatatgggtatgcagcgggcgcgcaggagggcagcccagtctttgactggtcggatctgggacttggcacatcagaggttcatcttggagaatgctcggacgggcgttttgtggtgctggcagcctcatctgatcagactgaggtattatcgtatgaaatggcggtgctgaccaagggggtggatgagagggagattttgagtatggtgagcctgagcgcaacccccggccttgtccagaccgtatctgattttaacaaaacaaacgacaggtataaggttgaactgacagagtattttccgtatgcgcagaatgtgactgacgaggaatgggataatgcgattttaaatcttaatacacggatcatctccggcgatatgccggatatcctggatatgagtaatttgtctgtacagatttatcaaagcaaagggcttttagaagatctctatccatatatggaacatgatccggaaatcaggaaagaggattactttgaaaatgtctttgaagcgattagcctggatggaaagctgccctatcttacggacggagctgccatatccactatgctggccggtgaagatattgtggttggaaacgatggctggaccattcaggagctggaaaaggtccttgatacttacggagccaattccataggtaatctgtccggagctttcttcctaagggtcatgcttcagacggatggcagttttattgactggaatttgggcaaatgctcttttgattcacctgaatttgtaaaaatgctggaatttgccggtaaaatacaggaaagcagccagaatgcctttgcaggaacggagatgggcgaaaactatgcagcagcctatgaaactgtgctgagcgtttaccacatcacccggtacagaaattactataacgggaacctgagatttcttggacttcccggaggcggcggtgagtaccacgtaatcaagccggaagtgaaggttggaatctcctcgtccagcctccggaaggaaggggcatgggaatttgtcagaacactattgacagaggagcatcagatgtcatgtatgatgcttccgattcataagagggcgtttgataaggtcacgcaggcggcggtggatggaaaatctgtctggtcgtggatttacgaagacggcaaggcaacaaaagaagatgtggagctgacaaagcagcttttaaacagcgcagcctatgtggaaaatgacaatcagaccctggaatcactgatattggaggaggcccgggaatatttttcaggggccaggagcgcccgggaaacggctgaaagaattcagagccgggccagtctttatatcaatgaacaaatgtaaaaagcagaccgaatcattatgattgtgttccattaacctgataggagatgatacagctatgcgtttacagattggggaaaaaataagagaacaaaaggctatgcccctcatagaagaccgtgtgcagcgcatggctgtatatcttatgattggattttttgcattcatgttagtatgtacaatcatttcccgtatatctcattcttttactaccgcccatgtttcggtagcttcgatgacaggaaaaacgctgatgaacagggctgaaatggaagggattatccatgcgtcagcggagaaagggattagtcttccggatggccttaaggccgtttcggtcaatgcagggaagggcaaatcagtagaaaaaggcgaggcgctgatagaatttgatgtccctgccgtagaagaacggattaagaaactggaagaagaaatccgtatccttaacctgagaatcgatctttcagcaaacaatggcggcaatgatgtgattgaggcacagcgtaagcttgtagatgcccaaaaggcgtatgagcgaattgctgcgaagtatgccaggacagaggagcggctgaaagaagattatacaaaacttgaagaaacactggcagatgcggaaaagaatcttatgaataaggcagaatcgcttgtgaaggaagcgagggaaaacctgcaaaacgtaagagaggacgcggaggacgccatccgtgccgcagaacaggcgctggatgaggaatcagaacatcttgatgattcagaggatagttatcagcaggcattcgaaacgtatgagcaggcgaaagaagaacttgatatggcaaatcagagagtcagcgaaataaaggaagcgattgcagggaagcagccggatgatgccacggattatacggaggagctgaaggaggcggaggaagaacgttccattgcgcaaaaggcatttaaccaggccaaaaaggaactttcgaaagcagactatacctcatcgtcctatgacagggcagacgatgacctggattccatcaagagacgctggaaacgtaaaattgataaagccaaagatgctctttataaagcagaaacagtgctggaagcagtcagagaaggaaaagatttttcaactgagtctgcagtcaatgaggcccaggctgccattgatacggcaagagaagcgctaaaccgtgcccggcgtgagtctgaggataaccaatattctgaggaggaagaactctatgctgcgggaagggcagttgagaccgcgcaggcagcattggaagatgcccggagacaggctgaggcattgcagaaggaaggtgagattgacagaattacctgtgaatctgagcggtcagataaggagaaatcgcgtgctgcattacaggaaattttggatcatgggggctgccttttggctccggcccccggaacggtggtgaggacgctggaacgcggggataaaacaaaggagggggaagatgcagtcatactctcctctgctgacagaggatttgtttttgaaggaaaactggataaagattcagcacgccgcttttcagccggggacaagggagaactttattacaaattggatggaagcacacaaaaagcagatgtggagattcattccatcagcacgccggacgagtcggaccaggttttagtaactgcggttctgccggagggaggttatactcccggtatgcaggcacagctttttctgagcacaaaaagcgagacgtaccaaaattgtctgcctcttaccgcactcagaagtgattccggcggagaccacgtattcgtactccgcagacaaagctccgtactgggaacagaatgggtcattgcaagggtagatataaccgtcaaggaaagagacagtcagatgatgtatgttgatggcgcgcttacgtattcggatcaggtagtcataagctcaaataagatcatatcggaaggagacagggtccgcattgaaaattaacaggtttgctcattaccgggcgttgtctatatcagcaatactggcagcggttctttggtgtttcgcttgttctttctatagtacggccatcagtcactgtaaaagtgtgggcattaaatgggaaaagggcggtgtcagcccctcagagcttatcaggcagcagacctatgcaaggcaggatggggcaggaaaccagccggaggtcaccttatggcagatatacccggaacaggagatcatggcttcagatgaaaaaaagatgaaggcggatgttgttgacgtctttggagactgcggggatatatcatcctccatgctggctgacggcgcttatccggccagatcggatgcctctggctgtgccgtcagtaccggtctggcattctctctgtggggaagtaccaatgtgattgggttgccggtaaaggcggaaggaaagcagttctatgtccgcggcatatttgaggaggaagaaccaaggttattcttacaggcgcaggcagaatcggaagaacccttatccaatatgcagctgacgtttacaggtccgggagccggggagagggctagtcagtatctctcatcggcaggttttccggagggacggatcctggacctgacattatttgcatgggtacttggcatgatactccggctccctgcgatccttctggcatttggaatccttgagcgcgtgaccaggcatggaaaaaggctttaccgttatccccttctgctggctatttattttttaatcgctgtcggtatattggccgtattatggttttgtatggacctgcctgagtttccttccgagtttgtccccacaatgtggtctgattttgagttctggggaaatctgtttcaggagcaggggaaaaatatggtctcctggatgatggccgggcctgccttccgggatatggagctttggacctcgtcatttatggcagcgctgctttctgtgtgtgcctctgcctttacggcagccgcagcaatgcgggtatccatacgctcttacaaaagaatgattttctattgtgcggtatatacactgacgctttgcctgatttcattcaagatagcctctgctcacaatatgaccttttgcaaagcgatgtatcttctgccatgtctttggatatgtgtggattttctgttttactgcctgaaagaaacgcttgccgccgatgtccgtgaagggaggattatggatgaagaaaaaacgtgaataccgtgttctgaaccgggaacaaatggtaccctggctatttttgctgccgagcctgctgttcgtgagcattatggtgctgattcctatgctggatgctctgcgccgttcctttttcctggctgccggtgaccggtttgtggggtttcaaaattatctggcagtcttgaggaaccatgcgtttaagctggcggcagctaataccgcaaaatttatcttagtctgcataccgcttctgttacttttttccctggctgtttccctgatgctggcctccttcagggaaaagcgcggcattttcaagacctcgtttcttgtgcccatggcggttcccgttgcttcgattgttcttttgtggcgggtgttctttcataaaaatggacttctcaatgcattccttgcactttggggtatggctccggttgactggattggaagtaaggcagcctttggcgtgttggtatttgcttatctgtggaagaatttcggatatgatatggtgctgtggctgtcaggactcagcgccataaatccggcattatatgaggcggctcagatagacggcgccggaagcatccagcggtttgtgaggattacgcttcccaatcttatgcccacattatttatcattaccgtgctgtcgctgctcaattcctttaaggtgttcagggaggcttatttgattgcgggaggttatccggatgacagtatttacatgcttcagcacttattcaataactggtacggcaatctggatgtggataaaatgtgtgccggagctgtgatgatggcaactctggtatttattttaatattactgctgcaaaaaattatgaacagaggagataggatatgaaaaaatggcttctcggcgtgccccttgttttaattgcagtctttatatggctgccgctgtggatgttgatatccggtacttttatgggaggggcagagctgtctgaaaatctagcgcctgtcctggatggcaggggaggaacggctgtatggcctgttatggcgcgttatccgacactggcggcatatgtggaattattattggatacgccccagttttttacggtattctggaattcctgcaggcaggtttttccaatcatactcggccatgtccttttgggcgctcctgcggcatgggcatttgctaagtttcactttcgcggaaaaaagatactctataccttgtatattgtcctgatgctgatgccatttcaggtgactatggtttccagctatcttgtcctgaataagctgggcctgattgataccgtatgggcggtcattctgcccggtgcggcatcaacgcttccggtattcatcatgacacgttttttcatggacataccggaggcggtcatggaggcggcagccgtggatggggcttcctcacttcagatatttttacgattggggcttccgctgggagcgccgggcattctctcggctgtggtattgggctttttggaatactggaacgcaatagaagcgcctcaggcattcttaaaaaaccaggcgctctggccgctgtcattatatatgtcaaacatcacagcggataacgccggggtatcattgatcgcgtcactgattacactgatgcctcctcttttgatattcctgtccgggcagaaatatctggagcagggtattatatcttccggaatgaaagattaacacaggggattcataacatcgcctttccccttaaaatgcagcatatcggcaaaacggaaagggagaaacgggtagcagaagtggcgcaaaagctggagctggaggcataccggacatcacgatggtaacaggcgcggatttctcaggccaggccgggcaggaggtatattttcggctaaagccggaaaagatacattttttaaagagagattcttgacaatcgtcaagtggggcgaaaaggggctgtaaataagtccctttcttggattctaaagattaaacagtaatttgatgttattatgttacaaacatgatacaattctttgttaacctatacctttacccgcgaaacaactatacgcagtattgcgtcatggtgcgttcggacgagtatacccaaagggcacgccgtatttcatgcccttcgggcggacttcgtccgtcaaggtatcgattaaaaattttactgtgaggtgagatgggctatgagaattctggttgtagaagatgaagagatgattgcagatatcatatcggcagggcttaccagaacgggataccagtgtgaatgtgtttatgatggcgctgaggcggccgggcttttggaggcgaagcggtatgatttgattctccttgatatcatgctgcctggagcagatggttatgaactgatggaatatatcaaaaactacaatactcctgtgattttcattacggcaaggaccaggttggaagataaggtgaggggatttaagctgggagcagatgattatatcaccaaaccgtttgaactggcagagctgacggcccgcgtggaagctgtactgagacggtatggtaaaagccgggataagattgcggttgcaggaatcgaggttgatatggagtcaaaaacggtcgaaaaagacggccgcccggtggaactcacagctaaggagtatgatctgcttcttctgtttctcagaaaccggaatatcgccctttacagggagcgcatttatgaagaagtgtggggaggggagttcgatccggacagccggacagtagatatccatgtgcagcgcctgaaacggaagatggggctggagcattccatggtatctgtcagaaatgtgggctacaggctggaggtgtcagagacgtgaaattatggcagagattctgtctgtggccgctttccttcttcctgctgatatttcttgggaccggtgttctgctgattgaacagaatacgcggcaggtatttgaactgaacctaaaccagctctcagaagaacaaaaaagtatcacggaggggttaaactggtatatttataccagcagcgtccgcgattcaaggcgggggattggaaagacaaatggatatatccgggaatatatggaaaaccggcccagaatcagaggtgtgtattatctgattacagaggccggtgaaaatacgcaggaggtatattctagtctggagttggaactgccggttatgccgcttggagaagtgacctacactccgcaatataagaagctgcaatatggagagaaacactttctgcgcctttccagcctgtttacgctgccgtatcagacatatgaagctacctgttttatggatattacagacttcgtgcagaatcgcggccggcagtaccggtacttttttggcctcttttttgtaacagccgccgtgttggctgtgggaatgtatgggatatccagacatttgacaaaatctgtgcgccttctgaccgaatcaatcagaaaaatcggcagcggtaattatacggagcttgttgaagtaaggggaaacgatgaaatcagtgaattggcggcacgctataatgagatggcgcaggctgtcgaagataaagtatccgcattagaaaagacaacagaggaacagcggcgtttcattgataatttctcacatgagcttcgcactcccctgacagcggtggtaggatatgcggatttgctgcgctcagcggacctcgatccggacacatcgcaggagctgggggaacgtatttttaaacagggaaaacggattgaaaaattgtccgaactaatgcttcagctcgtatttttggaacatcacagctttgagctgattccctgtgatttacgggaggtggtgatggaggcggaaacgattctgcagccatcggttcaaaaggcacagatgaaactgattgtacaggttccgggggagccggttatggtacgggcagagagagaactgctgttaaccctactcgggaatctgacggataatgcaaggaaagcgtcaaacgtgggggataccatacggatttctatacggagagaggcaggggaggcgattgtagagattgaggatgaaggggaaggaatcccggagggagaacaggacaaagtgtttgaaactttttatatggtagataaggttaggagcagaagaaatgacggagtagggcttggactatccatctgttcggatatcgtaaagattcatcatgccagactggaacttgtaagcagggtgaaggtgggaacgaaatttacaatcatttttccaatgttacaatcatgatacaactcccggctaagatgagtccataccagtcacctggtaaatagaataaaaacgaggagattgcaatgggaaacagaagaaatttgaaaaaagtcacaggaatcttatgtgcgggagtgcttatacttagcctgtcaggttgtgggagcgcatatgcaaatgaagcgggaaggcagccagaggcaactactgcaggcggggatatgctgaaaacttcggaaaatgcgaaggagaccggaaaacctcaatcggatgctgcgtttgttgaactggcaaaagaagccctggaggattattttggggttgacttgacggatacgacaggatattctgtcagtgtacagtatatggacgcaatgcccgaatacgaggcagagcagcagacggtcgttacattccttccggaggagcttaactttggtgaaatctcggcagacactgtgattgatatggaaaatatcgacaccaaaccgatgtacgatgtatccttcaatgcggagggagccataaaagggatccatttaagttatgtggattgggcaaaaagtgagataccggttacggcacagtccgcggaggagacagcaaaacaattcgtgatatcccatcagctggcagcggaagaccgcttaaaggttctcggcagcgcagcagcttcatccgataccataacagtggtaatccagcataaagaaggacgcgcccttttgattggggtggattcactggctggaaacgtgagatattttgaagatatggccgaaaagagcgcggtaaagtcaatcacgccctttgaagagggaaaaggcttgggttgattggttttatgacacagaggcggcaccttatccggtaggaagcaggtgccgttttgtctgcgacattcccgcgggaaggtaacgcgaggattatatggaacagaatgagaaagaaagtttttttgtcgacaattttggtcattatctgttgaattttatatcagacagagtaaagattgccgggcaaagcaattctgataaatggagtttgctttttcataaaattgaggagtggaagaggcaatactttatatcttcagaaccggttgaaatctctggtacgattgtccggctaaggagtgcgcggtgttatccaatgtggtatatagcagcgactgattctacggtatttcttatatctgtgagggaaattatttaaccgtgtattgggtgtgacggaaatatggcagcgcgatgaggctcttgaatggataatgcctgctaaatatgatgttgaggagaaaaaattatgtatttaattttatttttatgtgtttcgttgggaatagcgctcattttgattaagggaacggaaaagaaaacaaagagaaaatatgaagaattccttcaggcagtgaggaaaggttcggaaacagcggtcccggaaactgccgggtttgaaattgtgatggcccagggggcgaaagatgcagtatcaacggtgaaaggttatgaccgaatccagactggttacgcctctctgccaaactttattgtccgttatagggaaaatgagatgtatattatggcagtaccttgtccctctaggacagagatggaggtagaccgggaatttattttacatattacaacggacattttaaaggaagtaaagctcggagttatgggaaaagtttctttttattttaaagacagcaaccgtttttttacaatgacagtgacagagtacgcaattccactcatgatgcagccggaggacaacaaaaaatttaagtcctatataaaggaatttgcggagaacgtgaatggttagagaggaggaacacccaagaagaagtttgaaagtccctattctgaaattcaatcggtgaccccctaccgggtagtgtttttcagtgcgggtatattcatccggatgaagtggaggagctgcctgtatttttaaagacacgaaatggaaacattaaaacagaaatttgaggtctgatagaaactggtgggagattgtacgaatagggaaggcaggcattttatagtggagtatcatgagcgtgagaaggaacgcgttcgcattttttggttttaaggaagatgaataaaatcgttcatttttataagcggtatatgtagcagtgtatgcctgggaggagaagattgaaaatgagaagtagaggttatccattaccttaagtacacgacaaataagccatctttcggtggctgctttaaaaattgaatattgaggagttaaggttatgcagttgctgacttgattttataaccctgatttcgtgcgataaggattgcctgttctaccgtgatctcacggtcaaccggaggcagattagttctgcattatagctttctccgtcctttaacatgtggtataatgcagtaagaagcattcttgctatggcaatgattgctttcttgtgaccgcgacgctttttgagacggagataacggttacgcatttcaggatgctttgagcttttaacgacagcgtttgcgcactatactaaaagcggtttgatatagcatccggctttggaaacccggacagattttttcttccctgcactttcattgctggttggagtaagaccagcccatgaacataagtgtttcgccgaaggaaaagcctccatattggtaccgatttcggaaatgattccgatggcagtgaacgcactgctgataccaggagcggtttgaagaatggtaagttcctgctgatagggagcggcgagcgcaagaatgagttcttcaagctctgctttccgggattcaaggctttcaaaatgagctttgattatcttgagtttacccgcctgttccggtgcaatatagccatcaatggcatcgcgcagttcaggaagtttctttttttaacttttgaaaacaaggggttcaaggtcaaaggaagtatcttcagggttttctaaaattttatccagtattgcctgagcagatttgccgaaggtgtccgaaacaacgtttcccaactggatattggaaaccgtgagacagttctgcaaacgattctttccccggatagccttaacatatttcggatgagcaaggacaatcgaacaatcattttcgagaatgttataaatcggaatccaatatttaccagtagattccatgcagacgtctttgcaattgcgagcgagtagccattgtaacaaatctttcagacctttcgtgtaggtggaaaaacggtggctctcgtaagaagtaacgccctgcttgtcagtagaggcaatacaggcgactacaaaagtcttgtggacatcaatactacaacagattttgtacacgatttttaaagccatagggactcctttcagaaccgagaaggttctctgagtatatatagggaggaacggcattgactgactgtctaagccataaacgaagttgtttaaccagagataagatttcgtgatcggaatcacacttatttgtgcctgaaaagccagtctacacatataaagatacggtcatccggcaagctggacagcccactcacctccccgtgatttgtagtataccgagttccctataaagaagaattataacgaaaaaataggcgcaggcaaacattttcataacgttttgtgcctgagcgaagcgaaaggaatggatataaggatgaaaggaagatggagttcgaaatgtttcataaccccatcggtgcctttcgcagaaaggtggattataagcatgaaaacgaaattgatcgggtggttggccgggtctgcagcggtgatgctcttactgccatgggccgcggtaacgtttgtccaaagtgatgccggaatggcggttacactgctgttgttttttgtgatcaatccgacattctccattgtatcagggatctttgcaggaaaatccataaaagaaatgtggtgcctgcctgtcattgccgccgccttgtttttgcttggcacatgggcgttctttgatgcgggggaaggcgcgtttgtcatatacgcggtggtttatctggtcattggtgtggcctcgatgctggtttcttcatggttctgtgcgggaaaacggcggtagccggcgctatgccgtagtagcggacctttttaaaatgttagtcagggatatagggcttgagttgtataaattctcaagctctattttttaatttggtactgctggctcaatttcgtcattgtataaaaaatgactaaattgaacttgacagtgacgaagaggaatgttatattttatttaagtcaaattagtatgatggcatagttgtacagggaatgggggaagtggatgagaaattatgattacactaaaaaatgggaggagctattaacaccgcaaattgtcggttaccttacaacgattcatgagtacaaaggcgagcagaggttgattgcaagcaggcatgcggatgtactgcatgacttggttgaagtggcgagaatacaaagtacagaaagctctaataaaatcgaaggaatttatacatcggacgaaagactgagaaaaattgtgctggataagacgatgccaaggagcaggaatgaacgggagattgccggctatcgagatgtgttgaatacaattcatgagaattttgaccatataccaatcagaactacttttatattgcagcttcacagagatttatataaatttgagaatggaagagtgggaggcgcatttaaaagcgttgacaacataattgaagaaaaaaatgttgagggggtgtcatctatacgctttcagccagtagcagcttgggagacttcggcgtcggtagataagctttgtgaagcatattatgatgtgataaacaaaacaaatgcagatccgctgttgattattccaatgtttatactggactttttatgtatccatccatttcgggatgggaacggacgaatgagccggttactgacactgcttctgttgtatcaatcagaatatatggttggcaggtatatcagtattgaaaaactgattgagaaaacaaaaggttcttattatgaggctcttcaggatagttcgagattgtggcacgaggaggaaaatgattatgcgccatttgtggcctatttattgggtgtgattgcggctgcgtacagagaattttttgagagaaccagattgattgaggaaaaggcaacggcaaagccggatcgtgtggcagaagcgattaaggaacagataggaactattacgaaatcggaaattatgcagaaggttccgggagtaagtcagacaacaattcaaagaactctgacagagcttacgaaacagggaagaatcaaaaaaataggaaatggacgctacacaaaatacacatggaattgggagaatgagcaatgattacaggagaattgaagaacaaaattgacgggctgtgggagatattctggacaggaggattaacgaatcctctggaagtgattgagcagatgacttatctaatgtttattcacgatttggatgagaccgataatattcatgcgaaagagagcgccatgctggggctgccgtatcagagtgtattttccggagaggtacagctgggagatagaataattgacggcgcgcagctaaagtggtctgtctttcacgatttcccggctcagaagatgtatgctgttttacaggaaatggtatttccgtttattaagagccttcatgcggacaaggatagtgcgtattcaaaatatatgggagatgccatttttaaagtcccaactcctcttatgttatccaaaattgtagatgcgatggatgatttatatcgtcaaatgtcaggtttaaaagatacggatgtgagaggcgacgtatacgagtatttgctttcgaagctggcgaactcaggggtcaatggtcagtttcgaactccccgccatattatcaggatgatggtggaactaatgcagccgtctgcagatgatgttatatgtgatccggcctgcggcacatcgggatttctggtggcagcgggagaatatttaaaggagcatcataaagaagagatattctttaacaaaataaaaaaagaccactatatgaaccacatgtttcacggatttgatatggataggacaatgcttcgtatcggcgcgatgaacatgatgactcatggaattaataatccatttattgaatatcgggacagcttatcggatcagaatacagacagggataaatattcccttattttggcaaatccaccgtttaagggaagcctggattatgacattgtatccgcggatttgttaaaggaatgcaaaacgaagaaaacagaactgctctttgtggaattatttgtcaagatgcttaaaacaggcggaagatgtgcatgtatcgttcctgatggggtgttgtttggctcttctgccgcacacaaggcgattcgaaaggaattggttgaaaaccaaaggctggaggcaatcatttccatgccatcgggggtatttaaaccgtatgccggtgtatcaacaggaatcttgattttcacaaagacggcacacggcgggactgatcaagtgtggttttatgatatgcaggcggacggattcagcttggatgataaacgctcgccgatatcagagaatgatatcccggatattataaagcggtttaccgaccgctcccaggaagtggggcgggaacgcacggaaaaatcatttttcgttccgaaacaggaaattgtggataatgggtatgacctttccatcaataagtataaaaaggtcgagtatgtgacggtagagtatccgcctacttcggagattatggataaaatattggaattagattcgcagattgccagggaattacaggagctgaaggcaatgttgtagatttggccggaaagggtcgggaaggaaaagcaatttaggcttgtgggaatgatagatggaaccaggagttaggaaatatcagattaaggatatttgtcaccttgaaaagggaaaacaaatagatacagatttgttagacgattctaatcaatacaaatatatcaatggagggatagagatatcgggtttatatagcgaatataatacaactggccagactatcatagtttcagagggtggtgcttcttgcgggtatgttaattatatggaagagccattttggtgcggttgccattgctatagattaacagatattaagatgaatcctaaatatgttttttatgctttaaaggcaaatcaggataaaattatgaaattgagaactggatctgcaatgcctaatataaagaaaagttcttttgaatgctttcaaataaggctttcagaaaatattacggagcagaattatgtagtgaaagttctggagaaaatatgcgctttaataaaattaaggaaaaggcagatagaaaaattctatatgcttattaatgcccgctttatcgagttggttggagatccagaaaataatcctaataattggccgatagttacaattggagcagtgataaaaagctgcgaatcaggttggagcggaaatggtacgcagcgtccaagaaaggatggtgagattgctgttctaaaagtcagtgcggtaacaaagggttattttttgcctacagaatgtaaagtgttggatgatcaagttaatattaagaaatatatttctcctgaaaaaggtgatttgctttttagtcgtgcgaatacaagagaaatggtaggtgccacagctgtgataacacaggattatccagaattgattttaccagataaactttggaagattcgctttattaacactgtaaatgtgttctatatgaaatatattttgagttatcccactgtgcgcgcaaaattttctgctgtatcaaccgggacaagtggctctatgtataatgtatctatggataaatttaaaatgatggagatccctatgcccgcttgggaagtgcaggaacaattcgcagccttcgtcgcccaagtcgacaaatcaaaagccgccgtccaaaagtcactggacgaaatgcaattactctttaacagtctgatgcaagagtattttggataatattcccataagactgcttgaaagtatgaaacaacagatccctcaccaaggaggtgccaatccatgaccaacttcgactatttaaaatcagagtcccagttcgagaccttcgcggatgtcgccatatctgcggagcgaatcatacatattgacccggaggcgtgtattatcaactgccgaagggcaatggaatttgccattaagtggatgtattcggtcgatcaatcgctggtccggccttatcaggataatttgtgcagtctgatgcatacggaggaatttcgggatattgttgacgaagatctttggaagcggcttgattttatcaggcgaatggggaataatgccgcccatggcggcaaaaaggcatccttcgatcaggcagaattgtgcctgcaggatttgtttattttcctggatttcatcgcatactgttatgcggaccattatgatgagcgccattatgacgcctctctccttgagacggaaaagcagggcggtaagccggaaacggaacaattcgctgagatagatttaaaggccctgatagcggaaaatgctgcgctgaaagaagagctgacagccaggcgggaggtgcaggcgccggaatatgtgacaaagccgcttgcgctatccgaatacaaaacccgcaagatttatattgattccatgctgatggatgctggatggacagagggacgggattggctgaatgaggtggagctttccggcatgcccaacaaatccggcgtaggatttgcagactatgtgctttatgatgattctcacagacccctggctttgattgaagcgaagcgcacctgcgaggatgtctccaagggcaggcagcaggcaaaattatatgctgatttgttggaaaaacagtataagcgcaggccggtgatattcctgacaaatggctttgaaacgcgaattatcgacggacagtatccagagcggaaatgtgcggccatatattccaagcgggatttggaaaaatggtttaatttgcttgcaatgagaagaggtcttcgcaatatcacaattgataaacgtattgcagggcgctattatcaggaagcggcaattaaggctgtctgtgatggctttgatgtgaagaataagcgcaaggcattgctggtgatggctacaggatctggtaaaaccagaaccgtgattgagctttgccatgtgcttctgaatgcgggatggattaagaatattctgtttcttgcagaccggaattcgcttgttacgcaggcaaagagaaactttgtgaatctgctgccggatctgtcctgcaccaatttatgcgaggataaagataactataacgcccattgcgtattttcaacatatcagactatgatcaatgtgattgatgaggcaaaggacgagagcggaaaggtgttttcctgcggtcatttcgatttagtaatctgcgatgaggcacacaggtctatttataataaatatctggatattttcaactattttgatgcgccactggttggacttacggctacgccgaaggacgagatcgataaaaacacatattctgtttttgaactggaaagcggggttcccacttacggctatgaacttgcacaggcggtgaaggatggatatctggtggattttcaatcagtggaaaccacgctgaaattcgttgatcacgggattgtgtatgatgaactttcggaagaagacaaagagctgtatgagattacgtttgaaaacgaaaagggagagataccggaagcgattagttcctctgctctgaacacatggattttcaatgaagataccatacggaaagttcttcatatactgatgacggaaggaatccgcattaactatggagaacagcttggtaagaccattatttttgcaaaaaaccatgaccacgcagagaaaatttatgaaatatttcataaggaatatccgcatctgcccaatgattacgcgaaggtcatcgataatcggattaaatatgcccaaagtgccattgatgagttttccgatcccaggaaactcccgcagattgcaatctctgttgatatgctggatactggtatcgacgtcccagaaatactgaatcttgtgttttttaaaaaagtgatgagtaaggcaaaattctggcagatgattggaagaggtaccagactctgcccaggattgctggatggaaatgataagaacaagttttatatttttgatttttgtgggaatttcgagttctttcgtgtgagcacaggtaaaccgaccgcaaatatggtggcgcttcagggggcggtttttaacctggaatttcagattgcttataagctgcaggatatcgagcgccagacgaagcgattgattgaatatcggaaaaaacttgtagaattgatggcgggtaaggtctcgaaactgagccgggaaagctttgcggtgcgtcagcatttaaaatatgtggatttttacgcaaatgcagagaactataacggattgacatatgagtctacattgactgtcagagatgagatagttccgctgattttaccggatcaagacgacgccagtgcggtgcgctttgacgcattgctgtacgggattgaattggcctgtctgcttgggcagaggtataccaaggcgcgtaaggatatgcttgggaagatcagggcagttgccggtgtggccaatattcctgaaatacaggcgaaaacagaattgattcaaaaagtccttcacactgattatttggaaaaagccgggattgaggagtttgaatatataagggaagaattgcgcagcttgatgaaatatattccagaaaaagaatcggtgaaatatatgacagattttacggatgatattttaaatatgacctggaatgattcggacctggataatgatgaattggcgaattataaggcaaaagccgaatactatgtccgccagcatcaggatacacttgcaatcgctaagcttaagacgaatcgttcccttaccgaaacagatgtgaaaacattgcaggaaatactgtggagcgaactgggaacaaaagaagattatgagaaggaatatggagaaaaaccgctgggtgagttcgtacgtgaaattgttgggttagacatgaatgcagccaaagaggctttcgcaggatatttggacgagactaatttggatagcagacagatttattttgtcaatcagattgtggaatatattgttcacaacggaatgatgaaagatttgtctgtgctgcaggaaccacccttcacggacaggggcagtgtggcggagatatttacggatatgaatgtctggctgggcatacggaacgtgatcgagcagattaacaccaatgcggtggcataagaaaaattgggggttcaaagatggaatggagtgagaagacagagacggttccggcagaggaagagaatacggctgttgtgaacaccgcggaaagcggtctgcagctgacctgcagtgttgatgatatgcttacctatgcgaacatccataatggcgcgcatatcgtcagggatatatgtctaaagaatgtatctgagaccgatctggaccatttgttgattcggatcagttccagtaatgagcttacggaggagttcaagctgggaattgagaagataaaggccggtgaggaacttcactttaagaatttgaatgtgccggtcaatgcagagtatctggccgcccttacggaacgcagttccttccggctgaaggtaggcatatattccggggatcatctgttggtctcggagacaacaaatgtgacggcgctggcatttgatcagtggccgggcctgcagtacacgccggagctgttggctgcatttgccatgccgaatcatcctgtggtgaccggtatgattcagcttgcggccggatatctggagaaatggacaggagatccgtccctggcgggatatcagtttgaagatccgaaccgggttaaaagtatggctgcttctgcttatgcggcgattcagcagaaaaatattacatatgcagagccgccgtccagctttgagacgttcggtcagagagtccgtttggcggacgccgttttggatcagcatctgggaacctgtttggatatgacgctgttgtatgtggcatgcctggaggcaatggggctgaaccccatcatggtcatgatgaaggggcatatcttcgccggcgtctggctgatcgatggatctttttcggacatgattatggatgatccttctcagctggaaaagcgtatgtcaaggggcattcacgagatggttgtggtggagtgcaccgccatgtgtgccggaaaaagcactagctttgatgaagcggtggctctggcagaacataacgtctcggattatggccgttttgctttcgtgattgacgtaaaacgtgccagaagcatgggaatccgtccactgccggttcgtgtaaagacggctgaaggattcgaaatacagcatgaggacagaaatgaaacggacgttacagaggcttccagaaatacagttgaaatatttgacatttcggatgcggtaaggaaggaaccggtcacaaaactgacgcagtgggaacgcaagctgctggatttgagtctgcgaaatatgctgatcaatatgcggatgacgaaggcggtggtcccgctgttgtcttctgatgtgagtattcttgaagatgcgctgtctgacggcgaagagtttcaggttatgccgcggccggcggaaatggcaattgccggggatggcggcgttccggttgaggcgctgggcgatctgggtccgtttgcggattttatcgccttggaaagtaagcacaagaggctgcattccctctatatggagaaggagctgaacagctgtctgactaaaatgtatcgttctgccaaaacatccatggaagagaacggcgcaagtaccttatatctggcgctggggttactgcggtggtttgaaactaaaaacagtacgactgccagatatgctccgattgtgctggttccaattgatattgtccgaaaatccgccagcaaaggatatgcgatgcgcatgcgggatgaggatgcgcagatcaatattacgcttttggaatttctgaaacagaagtttgatactgagatatatgggctgaatccaccgcctgtggatatgcatgggctggatatgcctaaggtatttgcaattatccgccatgccgtgatgaatctgccgatgtgggatgtggtagaagccgggtttatcggaaatttctctttctcacagtttgttatgtggaatgatattcacagcaacagctcgtttcttgaaaacaataaaattgtacacagtctgatggcgggggcggtggactgggattgtgcgatcccggaatgtgtggacacggacgaggcttatttgccggttaccgtagattcgtcccagctccgtgccattaatatggcggcggcagacgtcagctttgttcttcatgggccgcccggaaccggaaaatcacagaccatcacggcaatggtggccaacgccctcacgaagggaaagactgtgctttttgtggcggagaagatggcggctctggaggtggttcagaagagactgactgccctggggattcaggatttttgcctggagctgcattccaataaagcgacgaagaaggcggtgctggatcaactgaggcgtggacttgagatcggccttcagggaatgaagacagactacgataaaaagattcaggatattcgtaagatgcgtggggagctggacggatatgcgagagctctgcacgtaaagcggccatttggaaagagccttcgtcagctgatggatatctatgaaatgatccctgagctgaataaaagcgttcattttgatcgcgcttatgccggagcccttactgaaagtgatctggaccatcaggcttacagcctggaacgcctggttgcggcgggaaagggaattggccatccgcacaatcatccgctgatggccgttcacaagacagagtacagccagcgcctgaaattcgatctggaatcgattatccgcgcatatacggatgcgttgacgaaatttcaggcagatgtgacgggctttgtgacgatgatggagcttcaggctcctgttagcgacgaccagtatcgaaccatctgtcattatgcggacagcgtaattgcggcggaagagataccggcatttttgcgccagacagacaacgcggaccgggaatttgcggcgccggaggcatttctgaaaaagaaacaggccttttctttgaagcaggcggctgtcctctcaaaatggaacgaaaatttcctccgcatggatatgaatttctatcgggaaaaatatgaccaggcgaacaagaaattctttggcaaagggaaggcactggctgctctgacagcagagctgcaggcatttgcggcgtttgaggtagagacggagcggattccggtttatctggcagatattatcttttatcagcaggaatcacgggaaatggcggaggcggagctgtcatatgactggaagcagattttagatgttcattttacggcagaagcattgcaggcttataaaaatgaagtcaagagacagcggcagattttgtctcaattctcggatcagatacgaaagctagaagcccaggggaacctgaagtcctgcattcagatggcgaaatcactgaccgcggatctggataccgtgcagcagaccgaggccagggcaacggagcttctggatctgtcatttgatcatgccgatgagaattttctggagagcaggctgagactgtgtgcgtgcattctcgaacacgcttcttctatcaaggattggattatatatcggcaatttgccgtggagtgcaggcaaaaggggctggggccgatctgtgatgcgtatgaggccggtctgccccacgacgaggttatgatcgtatatctgcgctcggtctacaggacgattattttgtcggtgattgaacatgagccggtactgaatggattcaccggaatcggattcaatgaaaaaatcgcacagtttaaaaagctggatcaggaattcatggatctgacaaaagatgagatgttctataagctgactcatcagctgcccacttcttacgacagtgtggaaatcagcaaggaattgaatatattgagacgagcaattagcagcaacggaagagggctgtccatcagggccctgtttgagcagattccgcagattctgacaagactgtgcccctgcatgctgatgagcccgatttcagcggctcagtacctgaaggcggagaacgatctgtttgacatcgttattttcgatgaggcttcgcagcttccgacctgcaaggcggtgggcgtgttggccagaggaaaaaatgccgtcattgtaggcgatccgaaccagatgccgccgaccagcttctttgcagggaatacggtggacgaggataacctggacattgaggatttggacagcattctggatgactgtctggcgctggggatgccgtccgcatatctgcactggcattatcgaagccgccatgagagtctgatcgccttcagcaatcaggaattttatgagaattcgatgtttacattcccgtcggtaaatgacagggagagacgcgtgggcctggttaaaacagaaggattctttgaccgagggaaaggccgtgtaaatgaaggagaagcaaaggcgattgttgcggagatccgcaaacgatatgaagaccttgtgcgaaaggatcagaccgtcggggtggttacgttcaatatcagtcagcagaccttgatcgaggacctgctacaggtggaataccagaaggacgctgcatttgaccagtgggccaatgcaggggaggagccgttgtttgtcaagaacctggaaaatgtccagggggacgagcgggatatcatcctgttctccattgccttcggcccggatgcagagggcaagctgtccatgaatttcggcccgctgaataaagccggcggatggaagcggctgaatgtagcagtgtcacgcgcgcgatccgagatggtggtatttacgacgatgacttccgatatgatcaatctcaaacggacaaagtccaaaggggtcgaagcgctcagggatttcctggaatttgcccagaagggcagattgcagggggaatatatcgaaaccagagtgcagaaggaacagggaattatggaacatatctgccgggcgattgcggatggcggatatgagtaccagcgggcggtgggccattcgaaattcaaggtggatatcgctgtgatcaatccatacaatccagaagcatatctgctgggaatcatgctggatggagaatcctaccggcaatccacgaataccagggatcgggaagtggcccagatcagtgtgctgaatggattgggatgggagttgcaccgaatctggaccatggattggtgggacaaccgggataaagagcttatgaagttgatgcagctcctcagtgaaaagaaggaagcggcacgccgggcttatcagcagcaggatagtgatttggcggaggtgactgaagaaccggaggaaacggtctgcaacgccgccgcagaggaagtaaagccggaagtgaagactgatcaggaagaagcttctgagggagaaacgacagatgaggtgatttcggagcaggaaccggagcctgttaccaaggggcattttgtggcccagaatccagtttctgccatagaagatgtgaaagtggcttcgggtaagagcgaaacaacgggagccattacacagattgagcctgaggaattggattaccgtgtggcagaatatagatacgcggacattgaagtgacggacctgtccactgccgattacattaaaaaggaaaatctggcgctgattgtggatcgcatgcagcggattatcgatgctgaggctccgatcatatatgaccggctggtgaagaaaacgctgcgggcatttcacattgcaagatcaagcccgcagacattggaagcgaccgacaaggcgttaaagaaggtttcagcgcggatgaataagcaggccggatgtaaattctactggtgtagggaacaggacccggatcaatacagaatttgcagaacggaaacgagttccggtgataagcgatcagcggacgaaatctgccagcaggaactgaaaaacgctgtctgtatcgcgctgaaggaaaaggggcctcaggataaggagagccttgtgaaaagcgcaatccgaatcatgggctatgcccgcagcagccccgcgctggcggctgctgttgagaaagggctgaagtacgggagaaagaccggggagatcgtgcaggatgaagagaagcggtttgttctgggaaagtgatcattaaaatatagccataaaagaatatccacctctccaaacaggagtcggacaacccgtatcaggcgtccgactcctgttttgcagtatcataccgaaaaagaaggataacaaacaaatgaaaacaattctaaacgattgacaatgataaagaataatagtaaagtaaagtcacagaacaggattgacaacagggaggtgataggatgtttgcacaggagcgtagggacgtgattcttcaggtgttgcaccaggatggaacggtgctggtgaaggacttgagcgagcggtttgccgtgacggaggattgcatccgcaaggacctggcgtttctggagaatcaggggtttttaaagagaacctacgggggagccatggagcttcgcagcaatccgcataaatttcatgtcagcgaccggaaatcggaagatatcgaggggaaacagatgatcgccaaaaaggcgtttgcccatctgtccagaggggatacggtgtatctggatatttccacctccaacttagagctgatgaaggagattgtgcgaaacagtctggaggtcaaggtggtgaccaacatggtggacttgattcccctggccgcctcgggtgggattcagttgttctttaccggaggggagctcaacagaaccggcgacggtttctggggttcgggcgcgatccggttcattgaaagcttccgctttgacaagggcttcttcggggccgtgggtatggatgtggacaccggaggggcgttcacttacgatctggaggacggcagtgtgaagagcgccgcgatccggtcgtgcagaagagcgtttctggtggcggagcaggagaagtttcacaaggatggcaattatgaatttgccaggctgacccagtttgaagcggtgattctggaccgggaaccggatcgggagatcggggaaaaagcccagaaggcaggcgtattgctggaataaggagggatgtatatgccgggatcaaaacccatactctgcggttccatcgcggggaagatcgggggactgggagttgtgatgcacaacagggcctaccagaaggcggggctcgaggcagtctatgtatcctttgagcccacaggggcaaaggaagcggtggaggccatgagaaatctgggaatccgcggaatgggcgtcacaatgccctacaagacggagatcatggagtatctggatgagattgacgaaacggcggccgccataggggcggtgaataccattgtcaatgaccagggaaagctgaccgggtacaacacggactaccgtggggccatcgacgggttgctggaggagaccgggctgcgggataagaaggtcgcgctgtttggctccgggggagtgggtagggccattctctacggactcttaaaggaaggggccagggtgaccgtgtacaatgtgcttcccgaacaggcggaggccctgtgccaggagatgggcgcgcagttcggcggtctgcctggggcatttgacaaaaacgccggctgggatgtgctgattaacgccaccccggtggggaatcagtccagcgagacgcttttaagggtggaggaatttccgccgggcattgtggtgctggatgtggtgttcaaccccatacacaccacctttgcggcagaggccttgaaggcaggctgccgggtggtgcggggaacgaaaatgctgatacttcaggccattgcccaggatgagctgtatctgggaatccgcccggactacgatgtgatggaacaggcgttgattgagaaattcggaggaattggctgacagaacggtgggggatcatatgctgtcggaaaaggctgcaaagatattgttattattgatccggcatgaaaacaggaccatgacggccggaaagatcgccggtgcgctgggaatctcggagcgcagcgtcaatacatatttgaaagaggtctacgacttctgccgggaagagaacatccgcgtgagcaataagaccggagtgggaatcgcggtttgctgtcccggaagggaggaggagcttgcgaggcttctctcgggacagatcggccgggcagattccccggattccagggtccgctatatggtccgggttctcctaaacaactggaacagctacaccacggcgctctttgccgaggacttgaaggtgtcgaagaatacggtctgccaggatttaaagcgggcggaggaacagctgaaccggatggggctggaggtggtgaaaaagacgggagccggtatctatgtccggggaccggagccaaagctcaggcgggccatggtgcgggtgaaccgcatggccggcccggacgaaaagggggctgggaatcagccggaacgggataccggggactgccggatgaaggcagagaccttcgtcaggctggagacctgctatcgcggctgccgtgtaaagacctgcgtggagctgattcggaaaatggaggatagctgggggagaaagctgtccgaccgggccctggaagcgctgacggaatatctgatcgtcaccagtctcagggcaaagaacggccatgtgatccagaagggtttcagggccggcgagggtgagaactgtgagggggccgcgaagcaggccgcattcctggcaaaggctctggagctgccgaaggaggagcgggcttacgtgcagctgcttttagactgcatggaataccagggacaggtggagaccgaggcgggggagccgccggaggtctggggagacgaagccaaggcaggggaaaacgccgccgggtccgggggagccggaatcgccgacaagcccgcgaaaaccgaggccgaactcctgaccgacgacctgatccgctacgtttccggcgtcatcggcctggacttcacaggcgacacgctgttacggcagaccttaaactggtatcaccggtccgccgcgctgcggtgccgatacgggatcgagctggagaatccgtttttggaggatgtaaaaaagacctaccccgctgtgttctcagcctgctttgcggcgggcagcgtgatctaccccagggtgacgggcgaggagctttcggaaaatgaggtctcctacctttctctcctgatcggaggagccattgtccggtcggagaagaagatcagcgctgtggtgatctgcaacggaggggtgggaacctcccagattctggcaaggaagctgagagaccggcttccccagctgatgattctgggaatcttcggctcggagcaggtcagggaggccgcaaggctgcgcccccagctggtgatcaccacggtgagcggcattcagaccccctgcccgtcggtgctcatctcaccggtgctgggagagcgggatttaaagcttttaaaccgggcctgcgccgaagtctacaccaaggccgagacctgccggaacggcctggccggtctgctggacgaggacctgatcgttctggattaccaggggagagacaaggatcaggtgctgcgctttatggcggagggactggagcagaaagggtatgtgacggaacagtttctggaggacgttatggccagagagagccgggggagcacggctctgggatttggcgtggcgattccccacggagtgtccgggtacgttaaccgccctgcggtcagcgtggtgcgcctggaggagagtatggactgggcgggggagccggtcagtctgatcttcatgctggcgctgaactttaaagatatcgagagcaccagggcatttttcaacggtttttatcacctgacctgcgaagtgaagattgtggagcttttgcggggcgtgacaagtccgggggaactgatccgggtgatatcggagaattgtgtgtaatttagcaacaacagagaggggagattgatatggaacaggtcattacaacggatttggtctgcctggatgtggaggcggagtccaaggaggacgttatccgcctgctggcggagaagcttgacggggccgggagactcaatgacagggaaacgtatattgcggaggttttcaaacgggaggaaacctacgccacgggagttggattctcggtggcgacgccccatgccaagacggatgcggtaaagacggccagcgtggcctttgcccgcctcaaaaaggccatccactgggatgaggacgacgacgtcaccatgattttccagctggctgtgccctgtacgggggcgggggaccttcatttacaaattctggcggccctctcgcggaagctgatctacgacgaattcagggatcagattgcggcggcggccagcgcagaggagattctggcattgatcggggaccagattggggttcagtagcctgtatcattacaatagacgaaaataatataggagggtttagggaatatgaatgaattattagggattttaagggatgcaaggaaacatttgatgaagggcgtgtcgcacatgatccccttcgtggtggcaggcggcgtgctgtttgccgctgcggtgatcatcaacggggagggcgcggttcccgataccggattcgcggctgacctgtgggcgctgggcgccgccgccatgggcttcatggtgccaattctggccggatttatcgcattttccattgccgaccgtcctggtctggcccccggcatggccgccggtttcatcgcaaacagcatcggagcgggatttttaggcggcatcgcaggcggcttcatcgccggtgtgacatgcttttatctgaaaaagatcaaattgccgaaatcgcttagttcgctgaaatccatcatcattatcccggttgtgggcgtgacggtatccgcgggcatcatgtactgggtaatcggaacccccatcgcgggcctgatggaagcgctgaccgcatggctgaccggaatgtcccagggcaacaaaattcttctgggcgtgatctgcggtttgatgacggcctttgatatgggcggcccggtgaacaaggtttcttatgcattctgtgttggaacggtcagcgcgggaatctatacctacgcgggaccctccgctgccgccgtttgtatccctccgctgggcatggcgctggctacatttttggccccaaagaagtacacctctgaggagaaggaagccggaaaggccgcgctggccatgggctgcgtgggaatcacggagggagccatcccctttgcggccaacgatcccctgcgcgtcatcccctgtctgatgatcggcgacgccgtgggcagcgccctggccttcaccctcaataccacctgcaccgttgcatggggcggattcatcgtacttccggccatcagcaaccggatcggctggatcatctccgtgctggtgggagccgcggtgacggcgattctggtgaacctggtgaaaaaaccggccgctgaaaaagcggcggacgattccggggacgatatcgatatcagctttgagtagattgaaaggagaacatagattatgaaattactggcaattacatcttgtccatcgggcgttgcccatacctatatggcggccgaggccttgcagaaggcggctaagaaacatggaatccagatcaaagtggagacccaggggtccatcggagtggaaaatgagattacggccgaggacgtagcggcggccgacgccattattctgacaaaggatatgtcgattctgggcgaggagcgttttaaggatattcccattgtgagagtgtggattggggacgcgatcaagaaggccgacgccattatcggaaaaattgaaaaactgttgaacgagaagaatgaaacggcttgaccgtgggaggtgagcgccggtggaagaattaaagatgaacgcccggatcgggcggctgaaggagcggatgctgtccgagccgcggtacgcgtccattgaacaggcaaaaattatcacaaaaacctaccaggccaatgaagagaaacccaggatcatccagagggctctggcgctgaaagccgcgctggagcagatggagatccgggtggagccggaggagctgatcgtgggcaaccggacggcgggagtccgctacggggtggtatttcccgagagcggaagttcctgggtggaccgggagtttgaaacgctgcccacccgccctcaggaccgttttcaggtgcgggaggaggatatccgctgcttccgggaggagataaaaccctactgggtggggaaatccctggaggacgtgctgcgggcgcgatacggcggggagctggaccagatcgcgaaagtggtaaagatcaaccagaaggaccacgcccagggccacatctgcccggactgcgcccgatggctgaaaatgggcccggcggcgctgcgggaggaggcccttgagcgccttaagactgcggacggccagggcccggaggcggatttctaccggagtgtcgcgctggtgatggaaggcgctatggcgttcatggaccgctatcacgatctgatggagaaactggccggtcaggaacaggacccgaagcttcaggagagcatgcggtccgtggcggaaaactgccggaacctttcaaagcggccggcggaaaccttccacgaggccgtgcagtccatctggtttctgttcgtcatcctgcatatggagtccaacgcctcgtccttttcgccgggccggatggacagttacctggcgccgtattataatagagatattgaggccgggacgttggaccgggaaaaggcgctggagatcatcgagtgcctgtggctgaaattcaaccagatcgtctatctgagaaacgccaacagcgccaaattcttcgcgggctttcccatcggcttcaatattgtcaccggcggccaggatgagaacggaaatgattttgtcaacgacttatccttcctgtttttgaaagcccaggagcatctgggtctgccccagcccaatctctccgtccggctccacccggggaccggggacgagtttttaaaggcggccatccgggtggtggcaaagggcagcgggatgccccagttctttaacgacaaggcggtgataccggctctggaggaactgggaatcgacgaaaaggacgccagggactacgccgtggtgggctgcgtggagctgaccacccaggggaacaacctgggatggagcgacgctgccatgttcaatctgaacaaggccctggagctgaccctcaccggcggaaaatgccttctgaccggcgcaaaactgggtccggactacggcgatctgaccacctatgacacctacgaaaagctggaggctgtgctgaaacggtatctggacgagtacatggaccggatggtcaaagcctgtgaggtggtggaaaaggcccacatggagcttttaccctcgcccttcctctccgcggtgattggcgactgcatggagaagggaatggacgtgaccgcgggcggagcccggtacaacctgtccggtatccagatgatccaggtggcgaacctggcggacagcctggcggctttaaaaaagctggtatttgacgagaagcgcatcggcagggaggaactgctgcgggccctggagcacaatttcgagggagatgaggtcctgcgcgttacgctcctcaacaaagcgcccaaatacggcaacgatgtggagtgggtggaccggctgggggccaaatgggcggaatattttaaggaccggctgtcccattatacgaattacaggggcggacgctaccacaccggcatgtatacggtttcggcccatgtgcccatgggggagaacgtgggggccggaccggacggaaggctgtccgggacgccgctggccgacggcggaatgtcgccggcgtacgggagagacgtctccggccccacggccgtgctgaactccgtagcccgtctggaccggaacctgaccagcaacgggggccttctgaacatgaaattcctgccggagtttttcaggacggagacgggaatcgatcagtttgccgcattcctcagaacctttgtggacctggagatcccccacattcagttcaacgtagtgcgcagggaggatctgatcgccgcaagggagaatcctgagcagtaccgggggctgaccatccgcgtggccggatataccgcctactttacggagctggcggatgagctccaacaggaaattatagccagaaccagctatacggatatctgacggggaggctgacgaatgacgggaaccatctttgatgtcagacgattttccacccatgacgggggcgggatcaggaccaccatgttcatgaagggctgccccctgtcctgcgtctggtgccacaacccggagggaatctccgtggagcccaggcccctgcattttccaaccaaatgcatgggctgcggcatctgctgccgcctggcaaagcatggcggaatgacccgggaggacgggggcgtgcggcttcacccggaccgccaggaggactggcctgcactggtggacgcctgtccggccggggccctggcctgggattccaggacggttaccgtcggccaggctgtggaggagcttttgaaagacagggcattttttaaatatgggggcgggattaccctctcgggcggggagccgcttctccagccggaatttgcggccgctgtgctgaaagggatgcaggaggaaggcgtccacacggccatggagacgtcccttcacgccggttcggaggcgctgcgtatggtgctgccgcacctggatctgatctacgcggatgtcaagatctgtgacagggaacgccacagaaggtacgtgggggccgccaatgagcagattctggacaatctggagctgctgctcacatccgaaaagcgggaccgggccgtcatcaggacgcccctgatccctgaatacacggcgtaccgggaaaatatcgccggaatcgccaggcttttgtcgggcctctacccggacgtcgcctgggagctgctcaattacaatccgctggcggaagccaaatatcatttggtggaccgggagttctgtttcaaagagaatcccgggcgctacacggcggaggagatggaagcatttgcccggacggcgcgggaaaatggagtcagaaatgttattgtggaaggataggtacagaatatgaaatttattatcgatgatgcggatattgcaaaaatcaaggatatttacaacacctttgcagtggatggggtgaccaccaacccgtcgattctggccaaaagcggccggcagccctacgaggttctcacggaaatcagggagttcatcgggccggatgcggaactgcacgtgcaggtgatcgcgccggacgccgagggcatggtgcgggacggtcatcggatcgtggaggtgcttggaaaaaatacctacgtcaaggtgcccaccacaaaggaaggcctgagagccatgaagctgcttcacgcggagggcatccgggtcacggccacggccatttacacccggatgcaggcatttctcgcggccaaggcgggggcggactacgcggcgccctacgtgaaccgcattgacaatctgggtggcgacggcgtgaagacggcccaggatattcacgacatcttccggaagaacggcctggactgccaggtgctggcggccagtttcaagaattcccagcaggtacaggagctgtgtgagtatgggatcggagccgccaccatttccccggacgtcattgaggcactgatcaaaaatgattccgtagccatggcggtggaggcttttgtgaaggatttcgagggcctgtgcggcaaaggggttaccatggagaccagcaagtgatatggaagagctgcaaaaagagatagagagaatcagacgggagcaggaggagctggtattcggcgcttttgacgaacagacggcctgggagacgggaaaccgcctccgccagatcgcccgggagaaggggtatgcggtggccatttccataaccctgaaccgcaggcggctctttgcctgcgccatggcgggaaccactcccatcaacgacgagtgggtcaggagaaaagaaaatactgtctacaagtttttcaagagctcctatgaaatgtctttgtatatgaagctgaaaggggattccatagggccgcggtacggcctggaggacgggctttacgcggccgccgggggttcggtcccggtgtgcgtgaagggcgcaggcattgtgggcacggtgacggtatccggtctggccgagcatgaggaccacgcgctggtggtctcggtcctgcgggagatgatcgcgggggagacggccgtggagcgggaataatggaagtggaaacggaaacagttgggcggagatatctgcgcggctgtttccgtcttttgctttacaatccctggaatattggctaagataaaactaataaacgcgaaacagagggaaatcaaaatgttgaaacaaaacggagaacaggatttaaggaattttacagagaataccttccaggaatcagtggaggagattgttccgggcgtctggatcgctttaagcatcggccacagcaacgcaatctttatcgaaggcaatacctccatcatcctgattgacacccttgacaccggcaaacggggagagcgcctccgggagatcattcacgctacaaccgggaaagaggtggggaccatcatctacacccacagccacgtggaccacaggggcggcggcggagccttcgatccctcggacccggagaccattgccttttcaccctgtgtcccggtgctggaacacagcggcatggtgcaggatattctgaacaaacggggcgcgcggcagttcggctttaccctgagcgacgaggagaacatttcccagggaatcggaatccgcaccggcgcggtgtacggggagtccagggcattccgcaagccgaccgttgtttacaaccaggatcaggtgatccgggaaatcgacggcgtcaccgtggtgatgacgcggattcagggtgaaaccgacgaccagattatggtctggtttcctgataaaaaagtgctctgctgcggcgataattattatggctgctggcccaatctctacgccatccggggcggccagtaccgggatatcgccgcctgggtcagaagccttgacaagatccgttcttatcaggcggagtacctgctgcccggacatacgaagcccgtctgcggcagggaacaggtggaggaggtgctgggcaatttccgcaacgccatcgcctatgtgctggaagagaccctccgcggcatgaacgagggcaaggacatggataccttggccgctgagatcgccctgccggagaaatatgcaaacctgccctatctcggggagtattacggcacggtcgagtggacggtccgggcgatctttacggcgtacgcgggctggttcgacggcaaccccacccatctgcgccccctggccccaggaaaaaggggcgaaaaggccgtcgccctgatgggcggcccccaggcggttctgcgcgcggttcaagctgcggtggaggagagggaataccagtgggcgctggaactctgcgacctgctgttaaatgccggggaaatgaccccggaggcccgaaggtggaaggcggcggcgctgaggaagcttgcggcgatggagaccagcgcgaacgggaggcactattatctggtgagcgcgtatgagctggaatcgggggagagcggcgggaatccattgcgttgattacccaggagatttttaacggatatagcaaaatttcaaggtcagccgatcagacggagctggcctttttgtgtgtaaacgaatttacagcgtaggtggggaaaatgtccgctaactgctggttttgtttgacagctttacaggaaaggattaaaatcatagttagtctttctatgagcagacccagcgctgctgttactctcgacagacttttatgccgcaggggttcgtttccggtgcgttagatctccgcacggcgatgcggtacatacgaatcaccataaattacaaagaacaaaggagggtgacgatatgaagaaaatgatagcgaaattaggcggcattttagttccgatcattttttgcatagcgctgatctatacagcaaccatgtcgctgaatttaacggacgatttacagggaaatgccagggtcataaattatatcggcatcgtacgcggtgcaacgcagagactgatcaaaaaggaattgaatcatgatccggacgatgagctgattctctatctggatcatattttgttgggactttcaaatggaagtgaagaattaaatctgatcaagcttgacagtgaagaattccagactcggttaatcgaaatgagagatgactgggaggagctcaaagcgcagatcgatcagtatcgggaaggcgcctccagccagcttctctatgaactgagcgaagactactttaaactggccaatgacaccgtgttcaccgcggaggaatacacggaacagacggtgcagcacgcaagaacgtcgcttgtgacagcgaactttatatttatattaatggcgatcggcagctctatctttaccttttatcaggaaaaacgccagataaagctcatcgaagcggagaaggaaaatataaaaaggagcgaacagctgtcaaaacgggcgcaggaattaatggcgcccatgaatgagatatcagaattgatgtatgtctcggatatggacacgtataacctgctgtttgtcaatgaagcgggaaagagaatgtttcaggtggatgacagcctgcccaatttaaaatgttataaagtgctgcagggttttgaagaaccgtgtcctttttgcacgaatcaatttcttaagctggatgaaacctattcctgggagtatacaaacccaatcataaaaaaacattatcttttgaaagaccgtttgatcgaatgggatggacgcatcgcgagaatggagatcgcgtttgacatcacggaagccaacaatgaaaagaatgaattgaaaagaaggctggaacgggacgatatacgccttgcctgcgtaagagagctttacaataaccgtgacatagaaaacgcaatcacaaaggttctggaatatattggaaaattgtttctggctgaacgctcctatgtattcctgtttcatgacaattattattccaatatcgcggaatggtgtaaggaaggtattttgccggagattgataatctgcaaaatattcccattggcgattatcaggtatggctggatgagctggagaaacacaaaaaggtagtgattaacgatgtggaagaaataaaggattcattccatgttggctatgagctgctcacgcagcaggggatacgaaatattatatgggtgcccctgattaagaatggaacggtaaacgggacaatcggattggataatcaggatttggggatggctgagatcgcggtgccgtttttgcagaccgtccagtattttctctctcttaccatgcagagaaatgaaaatgaaaagatgctgtttgagttgagtcaaatcgaccggctgacttctttttataatcggaatcgctttattcaggacgtatcggaattaaaagagcgcaaagcttccgttggggtggtctatttagatatcaatgggctgaaggagacgaacgactcgtttggccacgatgcgggcgataaattgattaaggcgtgcgccgatattatgaaaaaaagcgcagcctcaaaaaatctttaccgcataggaggcgatgagttcgtcataatctatctggatatcgcgaagggggatttttacgacaaggttcagctgttaaaaaatgcttttgagaagagtgcatgtcaggctgcgatcgggtgcaaatggagtgaagaatcggctgatatccaggagattatcaaggaagcggacgaattaatgtacagcgataaaaagaaattttatcaggggcatcacgctaccggccgctacagacataataatgacgtgttgagatttttggccgatcccgatgtattaaagcaaaaaatagagaatcatgagttcaccgtatatttacaagctaaaatagatgtggaaggcggcaggatggcgggagcggaagcgctgatccgttaccgggatgaaaatggatcgatcgttgcgccggatcgatttattccggtgctggaagatacatacctgatcagtaagattgattattatgtatttgaggaggtatgcaaagccctgagcgcctggaatcagcagggaaagtctgggattacggtatccagcaacttttcgagaatcacgtttatggaggaccagtttgtaaaacggatcgaagcgattagcgagaagtatcatgtgcaacgaaagtatttggagatcgagattacggaaagcgcaaaggttacagatttggacacgctggtagccagaattgatcagatgagaaattcagggttcagcgttgcgatggacgatttcggggtggaaagttcgaatctggcgatgctgtccttcgtgaaaatcgacgtgttgaaaatcgataaaagctttgtaaaagatattgttacaaataagagagcgcagataatcatcgggaccatgacgaaaatgtgcgaagaaatgggcattcaattaattgccgaaggcatcgaggacgagcagcagttagacgttgtgagagaatacggagtcaaaaccgtgcagggctatctgttcagcagaccgataccgatttcagagtatgaagaaaaatacataaaaagcccgcaggcggaaatcggcgggaattaaaatcttagcccgtatttttgcaatttccgcactgccgtagcctggctgatccccaacagcttcccaaggctgtaagttgaatcgcactgcttgaccgaactcctgagcagcttttcctccaacagatccagtatggcgggcagctcccgctgtccgatcagggaggtataatcgtcggcaggctccgcctcattcgctgcaaattcaggcaaaagaaacagatccttttcctctatttggtccccgtcggatagcacgcagagctgttccagtatatttttcagctcccgcagatttccgccccattgatgccgcatcagctgttcaatcgtccccgggctgatgcgcttctgggttcccgccgctttattgatgccgcttaaaaagctttgaatcagaaacggaatatcctccgggcgttccctgagcgggggaatcaccaccgacattacattcagtctgtagtataaatcttcccgaaaccgtccttcccggacgagctcgggaagatttttgcttgtggctgcgacaagccggaaatcgctgttgacggaccgactgctgcccatgggagtatagcatttgtcgtcgattgcgtgcaaaagcttcccctggaggtcatagggaaactcgtcaattttgtccagaaacagggtgcttttgtccgcaagggccaataaacccggtcttccggcgttccgcccggccgcagccggcgtttcgcagccgaacagttccgactcgatgagtccgccggaaagagccccgcagtccagtcggaccaaattgtggccgcgcctgctgctgatttcgtggatcagagtggcgatcacgtctttacccacgccggtctcccctgagatcagaacgtgtgcgtctgtctgggagatgcgggtcacctgtttgatcaccttgcgcatgatcccggattcggccacaatcttattcgaggtcagggtcaggtccatgagcttgtccgcaatattggagcagttctggcggctcagattgtccgccgagaccctgacgtcgatcatatcggaaatttctctggaattgatcacaactctgcgcacatccccgtttttgtccagtataggacttgcgatgaccaggattttctgcccgattttagtcgtctggacctcctggagccggcgcttcgtttggatgaccttttcgctgaggtccgaggaaataaacccgcccgccttcatctgcgcgctcgtttttcccagcatctcttcccgcctcagtccgtagatccgctcgcatgccttgtttacaaacacacacatacaggtgttgtccgtgacgtatatctcgtcgtaagagtggttggcgatctccagcagctccttgtacttcgcctttacctcggctaaagattttttgctggcatgcagatccgacagattgaacaggaacagcgcgattttgaccggttcgtccgcctcgtaatagggataggattgaatctccaggctgatgtcgcggtatacggcctgataggtctgcttgagattggagtagttaaatctggggaggatatcgtcgatccgcccgaggctggacaggccggttttgcagagcagacggttggcggccgtgttcatgctcaggatatttccatgtatatccgagaacatgaaaccaaaattgagatcggccaggaaggatttgctgatttttttccggtaggtgtcgtcggatttaatgtgatccagcaggagggccgtttgattggcgatcccgacgcagcggccgtcctcatcggttaccacaatggttttgcccgcgatcagttccgggttgatgaagcggcagttctgcgagagcgtcacatagctactgtcgcttatggactccaatacatgatcgaattgcaggccaaaggcaatctccttatagagcttgccggtgtgaatgattccgcagggttttctcctggcgtcgcacaaaatgatgtaatcattgtcaatatcattttgcagcagatagtggagcaaatcccggatactctgattaaagtaaaaaattggaacacgatcaacgtattttgcgtccataatgatcccccttgtttgtttcctgcgttactttattataccaaaaacactaagctcatgaaagacttcgctaagtgtttcggcatgtattctcactagattcgaaaagacctcgtcaagtgttcatatgataccataaaacgtgaacggacaattcagcattataattcaaaattgaattgtttttgccgttgaccggttcgggacatgcatataagatggaggtcaaagctgaggggccctgaagcggaacgattcaaccaagtttcttatggaggttatgatatggatggaaagcgattaaatctgccgatgacaggcatctgttcatttatgaaaaaggaaatctgcacggatttggatcggctggaggccgatgtggcggttcttggcgtgccctatgatatgggaatccaataccgctccggcaccaatcagggaccggaatgcatccgggccggttccaagctgacggcttttaccaacgacgacggggtatatgatccggaccgggatgagatgtttctggacagtcgctggcgcatcgtggattgcggcgacgccgatatcgtccacggcgacctggagcagagttttcggaatatcgaggaatcggtacgcaagatcgttgcaaagggcgctatgcccgtggtgatggggggagaccattccatcacaataccggttgtcagggcgttggacagcctgggaccggtctgcgtggtccagatcgacgcccatctggactggtgcgacgagcgggcaggacagagattggggcagggaagtcccatgcgcaggctttccgagatgaagcacgtaaacggcatggcccaggtgggaatccggggccttggcagcagcatgaagtctgacttcgaggcggcccgggcgtatggaagcgtgatcatttccgccagagatgtgaaaaagaaggggattgattacgctctcagccagattccaccggccgagcgttactatatcacatacgatatcgacggaacggacccggctctggtcacgggaacgggaaccccctccgccggcggccttgactactatgaaatcaatgatcttctctatggaatcacaaagaagggggaggttgtaggattcgacctggtggaggttgcgccccagtatgatccgtccgggtatacggggatctttgcggccagaatgatgattgaatttatgggctatattttaaaatcaaaagagagatagagaaccggcagaccttgaaccgttacgaaagcggaggaatacatatggatggagtgttaatcaatgataccctgttaatctttgcaatcatcattggagtcacggcctttggaatgtatgccgagaaaaaatggcgctgggccggtattttatccggtatgggcgtcagcatattcacggccgttgcgctggtcacctgtcatgtgctgcccactgcgtccggcgcatatgacgttgtttacgattacattatgcctcttgcaatccccatggtgctgctcgaggcgaacatcaaacgaatcataaaagagagcggtcattcgtttattctgatgaatgtggcctgcgcgggcgctgtgatcggcggtattgcagtgggatttctgtttcggaataacgcctacttcgcaaaagatatcgccgggtatgtggccatggaggtgggcgtgtgtaccggaggtacggtaaaccaggcggcaatggcgaaaacctttaacgtaagccacgacgtggtgggggcggccgcggtgggaagcaatctggtggcggtgtccttcctggttatcatcgggatgatccccaacttgaagtttttcaaaaagaatttcaggcacccgtatatggacgagctggaagcccaggaagtatgcccggcccagcaggtggagacagcggcggccggggaggcgcttggatatacggtgctgggatttgcgaagctgatggccttctccttcggcgtgctgggagtgtccacgctgatctgtaatttcatgggctctctgggactgcccactgtttttgatatgttgttcagcaatatttatctggtcacatccgttctgaccctggtgatcgtcaccacatttccgcggtttgcggaatccatgcggtttggacaggagatcggctcctttatgctgctgctgttcatgacggtgatgggcacgggagccagcatcattgaaatcattcagatcgctccgatgatcgttgtggctgaaattatcatcattttcttcatcatgacgatcacattggggattgccaaaatctttaaaatgaatctggaggaagccctgatctcaatcaactccagctacggcggaccggccacagcctgtgcctacgttgggagcaaaaagtggcagaggctcatgataccggccgtgctgatcggcgtatacggatatattatcggcaacgcactgggcatactggccggaaacattttcctatgatcaggattgtggggagggggttgtgatggacgcggattttatcagttcggagattgaacggaacagggatgagatcgtaaagctgagcctcgatctgtgggagaacccggaaggaccatatgaggagttcaaggccagcgcctggaccgcagatcttttggagaaacacggatttgaggtggagcgggaggccggagggattaagaccgccatcaaagcccgctatggcgcgggccgtccggtcatcggttttctgggggaatatgacgcgctccccggcctgagccaggcaaggagcagcgcgccggagccggttcccgggcagaactatggccacggctgcggccacaacctgatctgcggcgcgaatgcaggcgcggtcattgccctgaaagcgcagatggagcgggatcatataccgggtacaatcgtattctacggctgtccggcggaagaggttctcacgggaaaaccctttatggcgcgggcaggtctgtttgacgggctggacgcggccctggcgttccaccccatggagagcaacatgacgacctgcgggaacatgaccgccgcggatatggcgaagttccattttaaggggatttccgcccatgcctccgcggatccctacaacggccgctcggcgttggacgcggtggaactgatggacatcggggccaactatctcagggaacacatcaagcctgacgccagaatccattatgtgatcacggaaggcgggacagcgcccaatattgttccggaacgggcgtgcgtctggtattttgtgagagcggcgaggcgggaggacgtggaggaggtgtatgagcggctggtggacgtggcgaaaggggcggcccttatgaccggcacccagctggaggtcgagtatctgggcgggtgttataatacgttaaacaacagcgtgctggaggaggtggttcaccgggccatgctggagactaggcaggaaccctggaccggggaggagatcgcgtacgcgtctgagctgaaccgcttctatgaggcgaaccgggcggcagtgctggaccggtacgatttgccggacaatatggagatccacgagggcgtcctccccatgcttacatatggcgattgcagctcatcggacgtcggggatgtggcccacatcgtccccaccgccttttttacaacggcgtgcagcaatattggcgcgccggggcacagctggcagatcactgcctgctccgcccacagcatcggctggaaggggatgctgtacggggcgaaaatactggcaaaatcagcccttgaactgcttacggttccggagcttatggaaaaggcggaacaggaattcaggaaggcaacaaagggaaaaccttatcggtgtccgctgccggaagggatgagggcgccgggggaactatgagtttacccaaatgcccatcatagccatatcagttttccaaaagaccgcgcggccaggcaattcacctcataccacgcggtcttctttcgctatctcaaatattcgtttactaccgccagatacgcccccactcccgttttcatagccgcctccttccagctaaagcgcggatgatggtttatataccgcccgccgccctcatacccggccagcaggaagaaatacgcaccgggggtgccggttgcattcatgtagtaactgaaatcgtcgctgcccagatcatagtcaccgatctccacagagtccccgcccagatgctttctgcaggcgtccgcgaccagttccgcaactccttcatggttgatggtgggttcatacccatccacatactccaactcaaaggcgcaatccgtgattttcccgattccgtctgcgatatcatataatttacgctttgtgatatcacgggacgcaatatcgtaggagcgcacgttcatgctcaatctggcatgatcggcgataatattgacggcggttcccgcgttcagggtccccacgctgatgatctccgtatttttcggatcgatattccggctgatgatctgctgtagcgccactacatactggcaggacgccagaagggcgtcgtgagcttcgtggggcctggcggcatggccgctttttcctctgattttcacgttcaccacgtcgcagccgatggctacgggaccggatttgatacggattctgccgcactcgtcggagggcacgatgtgaagcccaatgatggagtccacatgtggatgttccataacgcccgcgtgaaccagggcctttgcgccgccggggaatttctcctccccgtgttcaaaaatgaacttgatacatcctttaaatgaatcccggtgctcagccaggattttggccgttgccagcagaatggccacatggccgtcgtggccgcaggcgtgcatgagcccgtcccgcctggaggcaaaggcgtaccctgtctgctccgtcaccggcagcgcgtcgatatccgcccggatggccaggcattttccagcgccctttccgccgtttaacagagccactaccgccgtctcacagacataatccacccggtccaacttgaactccgtcagcttgtcataaataaacgctgcggtctgatgctcctcaaagctcagctccggttcttcgtgcagcttccgcctccagccgaccatctcctcgtaaatctcttcgattaatctgtgaatctccataaaatttctcctttccgtttacagccagttggctactatccccgcaaagatcacagaggaaatggatacggtcacaattcccgcgatcaccatgtggggctgtagtttgctgcgcagataattctgctccgcctcattttcgcccacgctgcacgcgatttcattggccagaatgtaagtggtggggaagccgaacagcgcggatgtgcccagggccgtgctcatctgccagctatagtgaaaaagttttccaacaactaccgaagaaactgccaggcagattaaaccgatgaccaccacaaccgccagaggagccagctgacccagcagcatctggggagtggcattgaccagcccgataaaggcggcgatgggagccgcggccattacaaacacgctgccgttggctttggtgatggagctttcctccaaaaagccaatttcctttaacagtacgcccaggaccaggcacactaccagtttattcagcttgccgtcggtggcgtttgcaatcacggtggagatcaccgagacgatggccagtttggcgatgatcacattgccggagaggtatttcgcaggaatcggaggaatgatgcacagggcggatttgttctgcgccgccccattttccactgtcctgtccagatccccgccggtgatcagggctttcagccgcttcgcctcgctttttaaacagagggaggcgatggggatgccgataaaattttgtaccaccagtataacggaggcgaacaccaccagatcctcccggccgatagcctgggcagcttcctgcatgatcagggccgccacaatggcgccggacagaatgggtccgcccaccaacgcatagccccggtcgataaacagagtggcgatcaggcagatgccgaagcaaacgcctgcgcaggcgatcagcgcgatgaccacggttttccattgctccacaaagtccctgagtttgatggtggttccgatatgtaccatcaagaggcagaccagcgcgttggatatggcggtaaagccggaatcctgcagtgcggttgagggcagaaaggtccagaatccaatgagatagaagacaaatgcgaacaacatcatggaaatgacgcctttggtttttgtggcgacggcatcgcccagggcgtatacaataaatatcaacgtaaaagcaaataaagaatccatatcattcctcctgtgtacagatcaaaggttttgagcggtgtcagttcttgtcaaacatagtattcatacgatccagagccgtttgaagggtttttttggtaacgccgaaattcatcctcacaaagccgcgcccgtcctccccgtgggccagcccgttgttcaggctaattccagccttgtccagaaagacccggtccagggcttccggtttgatgccgctttcgctgcagtcgatccagaacaggaatccggcttccggcttaagcggcgtgatgggcagtccaatttcacttactgtcctgataaaatgatcccgattctctttgaggtaggcggtcagttcctccagccacagatcggcgctaccgcctgcaaccgccgtcacggccgcgatggagaaggagttggaggcatagttaaaattgtagcagtacacgaaccgctcccaccgttcccgcatggcccggtcggcgatcatcaccacggcgtggggaaggctcataaggttgaagcccttgctgaagctgaagatcagaatggatatttccttcgcccgttcagacaccgcgtagatagggatatgcttctttccgtcataggtgatcaggaaatgcacctcgtccgagagaatgcggacgttgtacctggcgcagatgtccaccatctgcgtcagctcctccatggtgaaaatgcgtccggtgggattatgaggattcaccagcagaaacagcgacggcctgtaccggcgtattttttcctcaaaatcatcaaaatccaattcgtagcgcccattcctttgcaccatgggatttgccagaaagcggcagcccgcgccctcgatccctgcttttaacggtgtgaaatagggagtctgcatcagcacgtaatcccccggcttcccaaacagccggacagccatatggatagccgccaatgtcccggggatgctgctgatccactcctgttgaaccgccaatccatacttgcggtcaaaccagctgatgatcgcgtcgtaataacgggcgggtttatagcggtagttgaaggtgttttccccgcataccgccagagtggcttcctttacgcatggggggcaggcgaagtccagatcggcagttcccatgccaatcacgtcctcccgcccttccggctggagccaacgcgtggatcctgtaaaccgatgatccaatgtaacgtcaaattgatacttcatagtgttcgtatacctcctgatgtttcctgccatggctttggtaaattcagtataccggaatctgtttgaattgaataatgccggtatctgatataaaatataaatagaattttatattaagggggagagtcatgacacttttggaaatcgaggcgtttctggcggtggtcaagtacagcaatctgtctaccgcggcccaaaatctgtttatcacccagccggcgctgaccaggagaatccagatcatggaacaggagctgggatatccgctgttcatccgtcgcaaggggcagcgcgaagcccagctcaccgaccagggagctgagttttaccatatcgcgtggaaatggcagcggctgtgggaggagaccaattccatcaccgttaataaatccagggaatcccttgccatcgcctcggtggatacgttgaatcacaatctattcaccgatctgttccccgagtttatcaagctgggctatctgctccggctttataacgccttttccgaggacgcctaccagtatatggagcggggaatttacgacctggcattcatcacattgcaggattacactcagcctctccccgccaggacccagatccggccggcctacgcagaagcctttgtggtggccacctaccgggagctgccgaatgaaaatgggttcgttaccacggaatgtctggaagaggagaaggaaatttatgtggcgtggaacaaggaattcaaagcctggcatgcggatcattttgacgaacagatatcgccttatgtgtatctggagcactcgtccctggccgcgtacctgctgcgggacgattactggaccttcgccccttataccacaggagagcattttcgcaggaagggcgcttacatctacgagctgaaggaagctccgccccatcagatcatttattatttggctaatggaaataaaaagcttgccgctatccgacgctttttggatttgctggataagcggcttggatctatgccggaggacaaggttcagtcgtttttgagatagaggcgcgagatatcgctgtggtgtctcctgaagatttatggtatactatgcgaagaaacgcgaggacaccatgggaggaccgaaatgaacaccgcatcaactaactggaaacaaaatttcttcaccatctggaccggccaggctttttcccagttttcaagctctgtcctccagttcgccatcgtgtggtatctgacggaccaaaccggctccgccatggtgctgaccatcgccatgatgatgggctttctgccccagggcgttctggggccgtttatcggcgtgttcatcgaccggtacagccgaaagcggatcatgatcatctcggacctgctgatttccgcggccagctttgccatggtggcggccggatggatgggggcgctgaccacggagctgattttagtcgtgctgctgctccgctccgtgggcgccgccttccacacgccgtgcctgcaggcggtcacgcctcagattgttccgccggaccagctgaccaggtgctccggttactcccaggctctggagtccgtgtcccagattttaagcccggcggtggcggccgtgctctacagctcctggagcttaagcggaatcgttttcctggacgtcatcggtgcgctgatcgcggtatttaccctggggatcgccgtgatacctgaattgcagcgggatgagaacagcggcggcgtgcgggtgctgcaggaggcgatggagggatttcggattcttcagaccaacaaggggatgctggggctggttttgatcggcagcctgtataccctggcgctgatgcccaccagcgccctgtttcccctgatgagcatgtcctatttcaacggcaccagcacaaacgccagcatcgtggaggtggtattttccgttggcctgctgtttggttccctggtgctgtcgagatggggagggacgaaaaacagggtttacaccattgttggttcattccttcttatgagcttcagcttatttatctccggcatgctgccgcccggcggcttctggctgttcgccgcctgttcctggctcatgggcgtgtccggtccattttactggggaatgtacacgccgctccttcagagcaacttcgaggaccgctacctgggccgggtgttgtccctctcctccagcatccggctgctcagcggccccctgggactggtggtctcgggggcgtttgcggagcggtatggggttgagaaatggtttctcatcgcaggcgtgctggtgctggcggcggcgtttttatgtgttggggtaccggcggtgcgggagtgcgatggatgaatgtatttgcgtttgcgttggaaaaagaaaacgttgaaaaaagaaaaaagaaaacgtgaaatgtaatccgagattccatacccgccattccggatgagtataaaaagttaatcgttattgatgcaaaagaaaggtatggattttcttttacaaatagaatgagactgactggatagttggtctcttttctgttatgctttgatttctggcggccagaaaggagccaccatgtcaaagtttttatcctatgaagatcgaatggtcattgctcagcgccttcaggagaacgcctcctttggtgcggttggtaaagagttagggaaagaccggacaaccatcgctaaggaaattaaaaagtattcttacgaaaagaaaaccggccgccccggatatccatataatccgtgtaaattccgtaccacttgcaaagcgaaaaaactttgtggaacgaactgtacgcatccatctgcttacaaatgcagtttatgctctgagtgcgcgcttcactgtcctgattttgcagaagatatttgctctattaaaacgaagccaccctatgtttgtaatggatgccgtcagctcccaaaatgtacgctgctaaaacgtatttatgatccggcagatgcacatgaaatggcacatcatgctatttcagaagccagaaccggtattctgtctaatgaagatgatatagcgagaatcaaccggatcatcagtcccctggtcagaaatgggcagtccctccatcagatctacctggaccatgttgatgagctgatgtgcagtgaaaagactctgtataattatgtcgatgcccagctgtttgacatcagaaacattgatctgccccgtaaggtaaaataccgtccacgctataagaaaccggaattcaaagtcgacaggggctgccgtattggccggagctacacggatttccagaagttcctgggcgaccatccagaaacgaccattgtacagatggacagcgttatcgggcgtacagggggcaaatgcctcctcacgatacactttgtggaaaccagtttgatgttagcgtttttacggaatgcaaatacatctgcttctgtaatacaggttataaacctgctggataaagttctgggaactgagacgtttgaccgtctgtttccagtcattctgacagataacggaagtgagttctcgaacccaaaagaaatcgaacgacgtgccactgttccgtgtaacagaacaaatgtattctattgtgatcccagtgccccatatcaaaaaggcgcctgtgaagtgaaccatgaactgatacgccgtattctgccaaagggaagcagctttgatgatctaacgcggaaagatatttttcagatgatggaccatatcaattcctataaaagaaaaaagctgaacaaccgtagcccatacgaagcgttcagcttttattacggagaagatgtgcttaagaaactgggatgttcaccggtagccgccgagaacatcatcttaaagcccaaacttcttaaaaagtaacagataaatttgcagggagccgccagaaaagaacaatcatacccggtcataacagggatggattctccgaatacaaaaatttcgagagggaattgatctctggttgctgtacgcaaatttattgctgaacttattgtaacataacgaggaacaaatgaaaacccgggaatcttggttacaaaacgggattttcatttacaaaacgggactctcggttacaaaacaggattttcatttacaaaacaggattcttgagttacaaacgggactctcgccttgctatttaccaagaaaaaagaaaatgcgaaaaaaataagctaatatatatgctaaaacttgcaaattaagctgatttaagctaaaatatgatctatgaacctatcgtttttaaaacaaaaaacacccacagagaccgcgcgtctcctgtccggccggatccgcgatatccgcaagagaaagaaattgtcacagataaaactgagcgaaaagtcaggagtaagcttagggtctgtgaagcggtttgagcagagcggcgagatatcgctgctgtctctgatcaaaattgccatagcgctggatatcagtgatcaactggagtgcttattcgaggacattcctccggcgtccattgaggagatcattcgtgagaacaattaatcatctaaatgtatattgccagggacgaaaagtgggtaccatggcgttatacaaagaacagtttgccgcattcgagtatgacaaagagtggctgattgatggttttgcaatcagcccattttccctacccttggaacagaaagtatttattccgaaaatagatccgtttgaagggattttcggagtatttgcggacagcctgcccgatggctggggaaggctgttggttgaccgccttatgcagaagaatcatgtagatcccaaaacattagggaatttggagcgtttggcgattgtgggtgcgacgggaatgggtgccctgtcatacgagccggattaccattttgaaagaaacgaggtttgtcaggatttagacaggatggcggaggagtgcgccaaaattctaaaaaggcagccctcagatcatttggatgaactgtttgtgttgggaggttcttcgggaggtgccaggcccaagatatttacccagatagacggtgaagaatggatcattaaatttccatcccatagggatgacccggaactgggaaagcaggaatatgattactctctctgtgcaaagcaatgtggaattgaaatgactgagacccggctgttttcttcaaagcagtgtgccggatattttggaacgaaacgttttgacaggacggatattcctgcaatagatgggaggattcagaaaatccccatgatatcggtcagcggattgctggaaacttcccatcggattcccaatctggattacagtattctaatgaaactgacgttggagctgacgaaagactttggggaaatagaaaagctgttccgtctgatgtgcttcaacatatttgcgcacaacagagatgatcattccagaaacttttccttcctgtacagcgaggaagaagatcgctggcgtttggctccggcttacgatctgacatacagcagctccatcaggggagagcatgcgacgactgtatttggaaacgggataaatcccggaatgggggagatactggcgattgcgggagaaatcgggattaaggaaacacgtgcaaaaataatcgccaatgatatcagggaaggcgtagacacacacctcagaacctacctgacaaataccagtggtacgccccatggatttgtagtataataggtaaatgtagcccttatcatcagcctggcggctggtgacaaaatataatgttacctgtattgcaagaagcaaagtagaacaacatgaggaggtattgaaaatgagaaagaacttcggagcaaaaccctatctgtacccgcagccggtgctcatcgtggccacctacggcgaggacggaaccccggacgccatgaacgcggcctggggcgggatcagcgataccacggagatcggcatgtgcctgagcaagggccacaagacggtgaaaaatatcctggcccggggcgcgttcacggtcagcatggcggacgaggcccatgtgacggagtgcgattacctggggctggtgtcggccaacgacgtgccggataagctggccagagccggatttcacaccaccaaaagcgagctggtggacgctccgctgatcgacgagctgcccttatccctggagtgcaggcttttgagctatgatcccgccaccggccatctgttcggtgagattgtcaacgtcagcgcggatgagcggattctgaacgaggccggcaaggtcgatcccgaaaagctttgccccatcacctttgaccccttcaacaacgcctacctgaagcttggcgaaaaggtcggcaatgcgttcaaggacggcagccagctgaaataggtgcttgcgggaggatggagatttggacggattggagcgttttgtacaggcccaggagagcagctatgcccgtgccttgcgggaggtcaaaaacggccgcaagacgagccattggatgtggtacatttttcctcagctgagcgggttggggcacagccagaccgcccggtattacgcgatcagagaccgcgctgaggcggaggcgtacctggctcacccggttctgggaaaacgcctgttggagatatcctcagaactgttgaagctggagtcctttgacgctacagcggttatgggctggccggacgatttaaagctgaagtcctcgatgacgctgttcggtctggtgagccgtgagcccgtattccggcaggtgcttgagaagtatttcaggggagaagaggacgtgtatacggtgcaggcaatatcgcggcaggccgacggttttaattaagaaaatatcagaacaaagagacgtgaggtcgattgaggccccgcgtcttttttgtttgccatcgtcgcagattgccccgctccggccctgtcgattgtcccggattcgcagccatttgccccacaagcgggaaaacgcggggattctgttaaaatacgaagttaagggctatgctgcagcgctgttgcagcagcctttaacctgaaggttggagctgcaatgggccgttgctgcggaattggttgacagaccgtttttgctgtcctataatataggtatacatatgtatactaattcgggaatttgaacgggagaaaacggcatgaaaaaaatcggtttgtcagagacagaatggaaattaatggatgagctttgggaggagccgcccaagaccatcacccagctcaccagggcgctggaggaggataccgggtggggaaagaacgtgattatcaccatgttaaagcgcctggaagccaagggggcggtgcgccacgaggagggggagagggccaaacagttttatccggcggtttcacgggaggatacggcgcaggaggagacccgggggtttttgaaccgggtgtatagcggcagcctgggactgatggtggacgccatggtgaacagccggtcgctctcggaccgggagatcgaggaactgaaagagattctgaaaaaggcggaggagggacggaatggttgaaactctgattacatcgtccgcgttgattgcgggaatctgcgcgttccgtctgctgtttaaagggcggatcagtccccggattatgtacgccatgtgggggctgccggcgctgcgccttttgatgccgctgttttacccggcggaccggtggctgaaaacgctgagaagctccttcagcgtgatgaacgcggtggaccgcctgcacgagcaggtgattgcaggcacggaaatggagccgcttgtggacaatattctcaccggccgggtcaggggatacgccaatcccgatacgctgcctcagaagctggtgggggtggactggcagctggtgtttctggcggtctggctgaccgggagcgcggtgctgctggtgtggattttgtgggtgaattttcattttgccgccagactgcggcggactagggtgcgctgccggggcgcagtctatggcgttacccatctgccggtctaccgcgtgttggatctgcggtcgccgtgtctggtcatgtttttgggcgagcagtccatctatctgcccgaagatttggaggcggaaccggagcagattgaacatattctgatccatgagacgtgccacgcccgccacctggatccggtgtggggagcgctgcgctgtatgctggtctgcgcgtactggatcaatcccctagtgtttctggctgcgtatttgtccaagcgcgactgtgagctggcctgcgacgaggcggcggtgaagcggctgggtgaaggatcgcggtttgactacggccggacgctgatcgccctgacggccggaaaacgagcgttctccgacctgttctgtatttccgcggacttcgtgttcgggcgaaagaccatgaaggagcgcatcacgctgctggcggcctggcccaggacgacggcgctcacagccgctttggttctggcggtctcagcggcgttgattgcctgcacctatacgggcaggcccgcccagggattgcagaagcggaccgagctgtgggcggagtatttctgcagccgggacgggcgggccttggccggtctgtacagtcaggaacaccaggacggtttttacgggatggagccggtgaatacggatgagagcgggaactacctgggcttcggctggtccagcccctggcccatggacgggcgctacgacatccaggcggagaacacgcgatcccagattacctactatgctatgacctcggagccccacctgtgggtgtggaaggagacgttggaatgggagaagtccgatggaatttactatgtggaccgggaagccctctcgatttttgacgcggtctccgtcttgacggaatttgaggctgcctacgggcaggggattgaagggacgcccttggattaccggaccaacggcatgggagcagctctcaacgagaatgtaaaaggcgatccggttatggcgtttttggctgcgccggagacggcaggcccctatctgctgaacctggagggcgggagagccgccgccgaaacggttggggatcagtcttcggtgacatacgagtttcgcgacggaagcagcgttgtgatccggatggagcgccccttcggagctgacggaatctgggtgcccaccgggtggagcggcgcggtggaagcggcggatgaagcggaagttgatgaggcggatgaagaaaatgtgggggtgacgccggcgccgggagaggcggagaggacggaggcagatttaccggaagcggaattgccggaaacggaggcggagaatgcggaagccggggcggagaattcggaggctgaggcagtcaaggcagtggtcggggaatttgctcaggcgtatttccgggacgaccccgcggccatggcccgggtcatgaccggaagcgcggccaagaagattgcaggagccggagagcagctctgggaccggctggacgcgtttcagatcaaaggagatttgagcgatgcagaaaaccgggaccagctggaggtccagtgcgagtaccgggtggcgggagaggactcattcagctatcttggagttgagttggtgcgggaggagaccggctggagcgtgtccggatattatttggaaaaataagaaattgtagttggggtttcgtccggaagaacagtcgtgggaacggcagctaagctgtctcccgcggctgtttttgcaaatcgtgccgttgtgcgggaaaaggacggggaaatcccgggacaacagatggaatttattgcattttccgccattcggtgataggatatagaacatatcgggtaaagagcagctggtgccgcggtccgtttagcggacgcgggtaaaagggaaacaggtgaaaatcctgtacgatctcgtcactgtaagcagggagtgcatggccattgtcatggacagtcactgattccaatggaattgggaaggcggtcattgcgcgcggatctgcaagccaggaaacctgccggctgttggtacgggaatagaagttccaaatcacgagtaattggttgtgccggtctgcggtttaacgccgcaggtctctgactcaaacggtgacggatttagctttggggacagtgcgtccctgagagatgggcgctgcacggcggtccatggcgttgcgcagcagctccgtggcatagtgcggcagctccgcggcatagcgctcctgccctatgtcatagcgcaaccgctttacggcgctgcccagcgcccccgccagtttgagacacatcctccaatgcagacagatggcatattcccctaccttttacgcagcgatatggcgtctaaaaaaaggaggaaaagaagatgagactgaacaaactggcggtcgtatttgcggcagcggcgctgtcggcggtgatggtggcgggctgctccggcggacagaaggagagcgcggcagagtccgagactgagacttctgcaaagaccacagaggcggagaccacagcggaggagacaaccatggcggagacgactgcggcagcggaggagatggacgaggagaactacgatacgggagatgcgtccagggacaatgtgagaaatcaggatgacattggtgagaatgagctgatggtcgtcagcttcggcaccagctacaatgataaccggcggctgaccatcggagccatcgaggaagctatcgagaaagcgtttccggattactccgtgaggagaggtttcaccagccagattatcattgaccacgtgaaaacgcgggacaacatcgccatcgacaatgtgggggaagccctggcgcgggcggaaaaaaatggagttaagaatctggtaatccagccgacccatctgatgaacggtctggagtacacggaccttgtgaacgaggtggcggagtattccgacgcctttgaccaggtggctgtgggccagccgctgttgacctctgagaacgactttaaggcggtgatcaaggtgatcacggaagccaccgcccagtacgacgacggcgagaccgcgatctgttttatgggtcacggcacggaggcggagtccaaccaggtgtacgccaagatgcaggaaatgctgaccgcggccggttataaaaattattatgtgggaaccgtcgaggcggcccccggcctggatgacgtgctggctatggttcaggccggcgattataagagagtggttctggagccgctcatgattgttgcgggcgatcacgccaacaacgacatggcaggcgacgaggaggactcctggaaaacaacctttgagaacgccggctatgaggtaacctgtctggtccgcggtctgggcgagatggaaggaattcagcagatctttgtggagcacgccagggcggctgtggacagtctggcaaagtagcatagttcccggcagtcgattggccggaatacgcccttggcggggcttaagttccgccgaagtaaataaaaaagaaagatggggcggtcggggaaatgtgctgatcgcccttttgaaggtaaaataaaaatgcgtatacataaattgcgtttatccgcagccattcttgccgcagtcctgatggcaggaggctgtggcggcaaagccgcaggaacggacgggacggccgcggccgcggagacgtcagaggtgacagggaccacagccggagcgccggatcattcggaggcccccggcgtgcagagctcaagcgccgcccccggcggacaggtggcctcggaaaaagagacggtcagtcctaaaaatgtagtggaagcgggaatggtaccggtttatgggacggaaataaaggatggcgtttaccccataaaagtggattccagctccggcatgttccgaatcacatcctgcgagctgacggtgaaggacggcgtcatgagcgcggtcatggctaccagcgggaccggctatttaaagctgttcatgggtaccggagaggaggcggcgcaggcttccgaagcggactgcattccatatgtggagacggcggacggcgcttacacctatgcggttccggtggaagctctggacatgggaatcgattgcagcgcctttagcaagaagaaagagaaatggtacgaccgggagctggtattccgggcggactccctgccggccgaagcatttgcggatgggaaaatcgccactgcggagagcctgaagctggaggacggcgtttacacctgtgaggtcaggctggacggcggttccgggcgggcagcggtggagtcgcccgccgcgctgcgggtggagaataaaaatgttaccgccaccattgtctggggcagcgcaaactacgattacatgaaagtggacggagagaaatacggcctggccgccgcggagggcaattccacgtttgagattccggtgaccgggtttgactggagaatgccggtcattgcggacaccatcgccatgagccagccccacgagatcgaatatacgctgacctttgactccgccacactgaagcgggtggattgatgatgaaatgtaaaatatttacaatcataatcgccgccgcgctgtttgcggccgcggtcagcggctgctccggccgcgcggggcaaaacgcaggcccggagcgcccggtatcggagcgggagagcggcttagcgggaaccggctccgatgcctcagccatcgcccccatacctggcgatgccgagcccccatcatccggcggtacagcggctcccggtaaggtcgccgcctcagccatccccccaaattggtccgacatgcgggtcgaccacagcatggatcttctctacgccgaccagttttccgtagattactatgacgacggctttgctatgattacaatcgcggacgataaccgttatcttgtagttccggagggggaggcggttccgaacggcatcccggacggcgtgaccgtgatccgccgcccgttgaacaacatttacctggtggcaacctcggccatggacctgttttgcagcctggacgccgtggaccggatcactctgtccggtacggacgcctccagctggtacatccgggaagcccgtcaggccattgagagcggaaccatgtcctacgcgggcaaatacaacgccccggactatgagctgatcctttccaaatcctgcgatctggccgtagagtccaccatgatctatcactccccggaggtgaaggcgcagctggaaacgctgggcatccccgtgctggtggagcggtccagctatgagagccatcctctggggcggatggaatggctgaagctgtacgcagtgctgcttggcagggaggaattggccggggaactgtttaaccggcagatgagcgcgctgaacgccgtgatggggcaggagcccacgggcaaaaccgtggcatttttctatgtcagctccaacggttacgtcaatgtgagaaaacccggcgactacgtggcgaaaatgatcgagctggcaggggggacctatgcgccccggaatccggcggaaccggaaaatgccctctccaccatgaacatgcagatggaagccttctatgccgcggccaaggacgcggactacatcatctacaacagcaccatcgacggggagctgaaatccctggatgcgctgctggccaagagcagccttcttgccgattttaaagcggtaaaggaaggccgtgtgtggtgtacggaaaaaaatctgtttcaggagagcatggggctgggaacgatgatcctggacatccaccggatgctcacggaggaggacccggatccgtcggaaatgacctacatctatcctctgcgctgacgcagagcgcaaacccataggagcaatctttatgacaaaacgatcctgcctgaggcatggcctctcatttgccgtgctgacagctttgatgtgtatgttaatgatctggaatctcaattccggcagcgtgcccctgtccgtaggggagatcggccagattttgttccggcgggccggggaagaaaccgcccggcgcattgtctgggacatccgctttccgcggattctggcggcggcgatcctgggcggcggcctgtcggtgtccggttttctgctgcagaccttttttgccaaccccattgccgggccttttgtgctgggcatctcctcgggtgcaaagctggtggtctcgctggtgatgatcgcgtttttaagccgcggcctgccagtgggctcagggggaatgatcctggcggcctttgcgggggccatgatctccatgggattcgtgctgctgatctccggaaaggtgaagaagatgtccatgctggtgatctgcggtgtgatgatcggctacatctgctccgcggtcacggattttgtggtcacctttgcggacgacgccaacattgtcaatctgcacaactggtccatgggcagcttttcaggaatgtcctgggagaacatacgggtgatggcggtggtgacgtttcttgccctcgttctggtatttttgctggccaagcccatcggggcctatcagatgggggaggtctacgcccaaaacatgggcgtgaacatcctgcggtttcgggtggagctgattttgctctccagtctgctctcggcctgcgtgaccgcctttgccggtcccatttcctttgtgggcatcgcggttccccatctggtgaaaagcctgtttgggaccgcaaaaccgctgcttttgatcccgggctgttttctgggcggcgcggtgttctgcctgttttgcgacctgatcgcgaggacggtgtttgccccaacagagctggggatcagctcggttacggcggtgttcggggcgcccatcgtcatctatatgatggtgcgcggcagaaggaacatgcagtgaggaggcggaatccatgacgggcgattacatttacgcggaacagatggacgtgggctacgggagcgttcccctcatccggcagattgaactccacgtcaggccgggggagatcgtgaccctgatcggacccaacggagcgggaaaatccacaattttaaagagcgtgatccggcagctaaatctgttgggcggcgcgatctatctggacggcgcacggatgcaggacatgccggagaaggagatcgccaggcgcatggcgatcctgatgacggagcggatccacccggagcttatgacctgcgaggacgtggcgggcaccggccgctatccctacacgggcagaatgggaattctgagcgcacaggaccggaaaaaagtgcgggaggccctggagctggtgcacgcggacgatctggccgggcggtatttcacggaggtaagcgacggccagaagcagcgcgtgctcctggcccgcgccgtctgccaggagccggaggccattgtgctggacgagcccacgtcgttcctggacatccggcacaagctggaattactcaccatcttaaaggatctggtacaccggaaacgggtcgcggtgctgatgtccctccacgagctggacctggcgcagaagatttccgattatattgtatgcgtcaacggaaattccatcgagcgctgcggcgccccggaggaaatctttacctccgcatacattaccagactttacgggattaccaagggcagctaccaggcggaacttggctgtctggaaatggaaccggcacaggggcctccccgggtctttgtcatcgggggaaacggcagcggaatccccgtttaccgcaggctccagcgcaggggaattccctttgccgccggggtgctccacgaaaacgacatcgactatccggtggcaaaggcccttgcctcccgtctgatcgcagagcgggcctttgaacccatcggagaggaggcgtttgcccgggcggccgaagtgctgaaagcctgcggccgggtgatctgctgcccggatcatttcggagccatgaatgaaagaaaccgtattttggcggagcttggggcggaccggctgtgtgggccggaggatatctgagcggtccgcccttctaaggcagcgcaaccttcagctgaagttccgtcacctgctcctccacatgtttggtggtgtggttgtcgatccagagcagctccagcagggggccgcaggccgccatgccgtggtcccgggcatattgcaggagctggggcacgaaccggcgggtctgccggaagctaccgctgtaacagacggacagataggatcccgcctcgatggaatgttctccctccgggtggaggaggaacaccgcctcatactgctggcagcgcccgtccaaagcatccgacaggttcaggaaggaacccatctggttgttgccgataatatactggcggtccggctcaaatgccaccagctgcttgatgaggacgtccatctcctcgtccgtctcatagctctgcatgatccggtggcagggccgttcgggcagcgtctttaaggaaatgatccccagcggcagccggactgcctgggcgatggtctcgcggcgggtgataatgttgtcccgcagcccctgaagccgggcgatctgctggtcgatcaggcacatttcctgctgaaacagctccagggtggagcccacgcttctgttctcgatataggaccggatctggtccatggaaaatcccaaatcccgcaggtcgcggatcacattcaggcaccacagatcctcggtgcggtagatccggtatccgtttggcgcccgccggggcaccaggatgccaagctcctcgtaatagcgcagaatgtccgtgctgatgccgtataaggccgcgatctcaccgattttataatatgtagacatggaattccctccaaatctggcaaattttgctgtataccttggtattataccaaggtttatactgaaattgcaacggcggttgtcaaaacagagttatctgcgctgtccgcgctgaaataaaagggggaattttatgaatttcgaaggtatttcgctgaagaaaaatttctggagatttgtctggccgtcggtggtggcccagtggatctttgcgctgtacaccatggtggacggtatgtttgtggcgagaggcgtgtccgagtcggcgctggccgcggtgaacattgtctcgccctttgtgaacttcctgttttccgtgtccattctcttcgcggtgggcacgtccaccatcgtggccatctatctgggccagggaaaacacctggaggccaaccaggccaacacccagaacctgatcgtttctgcggcggtgtccctgttgatcaccgtggtcatgtggctgggagtgaaccccgcggtccggtttctgggggctacggaggccaccatggagtatgcgcgccattatatcctgtccatccttccctttgcctggtgtttcatcctttcctacacctttgagacgctggtgaaaaccgacggctaccccaggttcgccaccatcgtggtttccctgggcgctgtgatcaactgcattctggactacctgttcgtcatggtgtttcactggggggtggccggcgccggagtggccacgggcatctcccagatgatccctgtctttttatacctgaagcatttcctcgggccaaaagccgtcatccggtttgcaaagccgtcctgggacttcgggcagctggtccgggtggtgaagatcggcctgtcctccggcctcaccgagctgtcggcgggaatcacggtgttcatgttcaatcacgccattctgcgctacatcggggagcagggcgtggtgagttacaccatcatcgcctatgtcaatatgatcgtggttatgtccatggcgggcatcagccagggcatccagccgctgatcagcttctactacgggaaacagaaccatgaggtctgcaaaaagctgctgcgctactccctggccgccaccgtgggcctggccggggccgcgtttcttgcctgcatgggcggggcgcagctgttggtcaatgtctttatctcaaaggagctgaccgaattgcgggcgtattccgcatccgtgttccggatcttcagcgtctcctttctgatcgtgggcttcaacgtggtgggatccggatatttcacggcggttgagcggccgaaggaatccctggtcatctccctgggacgcggcgtggtgatcctgtttgcggctctggccggctgtatcgccctgttcggaggcgagggcatatggtgggctcccacggtgtctgaagcggtctgcctgggaatcaccctgctgtttgtgcggggcatggcgggacgagaggagcgggagcggatcgaagacggggttcccgccgaaccggcgagcctcgaggccgggaagagcggcggggcggtaaaacggaagttaaccggctgaaaaatgttttacggaggcggggaaaaataatacccccctcgttttcgatagtagagagcaatgcaacataatcgcgattattgtaatggctcaaggccgaggggaagtgatgcggagaaaaacgggataaaatggtataagaattttaaaaatggaaatcctgttaatgtttttcaaagttttttaattactcaaaaatccggtttacaaccgaaccggagtgtgatatactgaatcggtatgaaatgacgccgatgcccggttgtccggtgactccagccgacggcctggtttacggtaagactaattttaatttaggaggaaacatcatgatttctaaggaaaagaaagcacagatcatcgcggagtatggccgcaagcccggagataccggttcacctgaggtacagatcgcgatcctgaccgccagaattgccgagctgacccagcacttacaggacaacaagaaagatcatcactccagaagaggacttctgatgatggttggacagagaagaggacttctggactatttaaagaagaccgacctggaaggctaccgtgctttaatcgagaaattaggcatcagaaagtaatttcaaacgttagggtggagttttcagagctccaccctatatttgcagttactgttccctttgttcccactgcatcgccctttacggagcgcgcaaacggcggcaaagcccccgggaatacggacaagggacgatttagttctacattctctctggcagaggaattaccccgagaccgctgatgtggccgtaaaacggcgatttgcggacagatcagtagtttcggcgtcttctgccagtgtaagatatgatttcaaagaaaaggagataaccatatgttcaaaagttacagtatggacctggcagggcgcaagctgaccgttgaggtaggcagagtggctgcccaggcaaacggcgccgttttcatgcactatggcgacacagtggtactgtccaccgcaaccgcatccaccaaacccagagagggcatcgatttcttccccctgagcgtggagttcgaggagaagctgtacgctgtgggtaagatccccggcggcttcaacaagagagagggaaaggcttccgagaacgcagtgctgaccgcccgcgtgatcgaccgccccatgcgtcccctgttccccaaggattaccgcaacgacgtgacgctggacaacatcgtgatgtccgtggaccctaactgcagccctgagctgaccgctatgctgggttccgccatcgcaacgtccatttccgatatccccttcgccggtccctgcgccaccacccaggttggcatgatcgacggcgagttcatcatcaaccccacagcggaccagaagcatgtgagcgatctggccctgaccgtggcctccacccgggagaaggtgatcatgatcgaggccggcgccaacgaggttccggaggacaagatgatcgaagccattttcaaggctgaccaggtcaacaaggagatcattgcattcatcgacactatcgtggccgagtgcggcaaggaaaagcacacctacgagagctgcgcgattccggaagagctgttcgcagccatcaaggagctggttcctccggcagagatggaggaagcggtatttaccgacgacaagcagacccgcgagggcaatatccgcgcgatcagcgagcgccttgaggaggcatttgccgagaacgaggagtggctgggtctgatcgacgaggcggtttaccagtaccagaagaagaccgtccgcaagatgatcttaaaggaccacaagcgtcccgacggccgcgcggttaccgagatccgccgtctggccgcagaagtggacctgctgcccagagtgcacggctccggtatgttcacccgcggacagactcagattttaaacgcctgcaccctggctcccctgtccgaggcacagcgcctggacggactggatgagaacgagaccagcaagcgctatatgcaccactacaatttcccgtccttctccgttggcgagaccaagcccagcagaggaccgggccgccgcgagatcggccatggcgctttagcggagcgcgcgctggtgccggtgcttccctccgaggaagagttcccctacgccatccgcaccgtgtctgagaccatggagtccaacggctccacctcccaggccagcatctgtgcctccactctgtccctgatggccgccggcgtgccgatcaaggatatggtggccggaatctcctgcggtctggtgaccggcgagaccgacgacgattacctggttctgaccgatatccagggtctggaagatttcttcggcgacatggacttcaaggtggcaggtaccaagaagggtatcaccgccatccagatggatatcaagatccacggcctgacccgcccgatcatcgaggaggctatctccaggaccagagaggccagaatccacattctggatgacgtgatgcgcccggtgatctccgagcccagaaagcacttaagcccctatgcccccaagattatccagatcaacatcgatcctcagaagattggcgatgtggtcggcaagcagggtaaggtgatcaacaagatcatcgaggagaccggcgtgaagatcgacatcaacgacgacggctccgtgaacgtctgcggtaccgacgaggcgatgatcaaccgcgcggttcagattatcaagagcattgtgaccgagatcgagcccggcatgatctttaccggcaaggtggtacgtctgatgaactttggcgcgtttgtggagctggctcctggcaaggacggcatgatccacatttccaagctgtccgagaagcgcgtgaacacggtcgaggacgtggtcaacattggcgacgaggttacggttaaggtaatcgaggtcgacaagatgggcagaatcaacctgagcatgaagcccagcgacctggctcccaagaaggagtccaagtaagcgggatccgctctgaaatacagtccgaaataacgtgacggaaaagacaatgccggtgaaaatcaggcattgtcttttttcatggagcgttatataatgtgttaatggaaacagaacaaaacgataggagatcgtgagatgaacagagttaggacaaggtatgcaccgagccccaccggccggatgcatgtgggaaatctgagaacggcgctgtacgcatatctgattgcaaaacatgaaggcggagacttcctgctccgcattgaagatacagaccaggagcgctatgtggagggcgcggtggagattatctaccagaccttaaaggacacgggcctgatccacgacgagggaccggacaaggacggcggctgcggcccctatgtccagagcgagcgtcacaaagccggaatctatatggagtacgctaaaatgctggtggaaaagggagaggcatactactgcttctgtaccccggagcgtctggagagcctgcgccgcacggtgaacggcgaggagatcatgagctacgacaagcactgtctgagcctgtccagggaagaagtggaggccaacttaaaggcagggatgccctttgtgatccgccagaacaaccccaccaccgggactaccaccttcaacgacgagatttacggggatatcacggtggacaactccgagctggacgacatggtgttaatcaagtccgacggctaccccacctacaacttcgccaacgtggtggacgaccatctgatgtccatctcccacgtggtgcggggcaacgagtacctgtcctcctcgcccaagtataaccgcctctacgaggcatttggctgggatgtgccggtgtacgtgcactgcccgctgatcactgacgagaaccaccacaagctgagcaagcgcagcggacattcctccttcgaggacctgttagagcagggctttctgtctgaggccgtggtaaactacgtggcccttctcggctggtccccggaggacaaccgggagatcttctccctggaggagatggtgaaggagttcgattaccgccgcatgagcaagtccccggccgtatttgatatgaccaagctgcgctggatgaacagcgagtatatgaagtccatggactttgaccgcttctttgagatggcccttccttatattaaggaagtgatccataaggatctggatttaaagaagatcgcctccatggtgaaaacccgtatcgaggtgttcccggacattgccggacacatcgatttcttcgaggagctgcccgagtacgacgcagctatgtacacccacaagaagatgaagaccaacagcgagacttccctaaaggtgctcactgatgtgctgcccattctggaagcccaggaggatttcaccaacgacggcctctatgaggccatctccaagtacgtcgcggacaccggcgtcaagaccggttttgtgatgtggcccatccgcaccgccgtttccggtaagcagatgaccccggcgggcgcaacggagatcatggaggtgctgggtaaggaggaatccctgtccagaatccgcaagggaatcgagaaattatcataaggcgggatcagaatggcgtttaatgaagcccagttaaaagcgatccggcatggggacggcccggctctgattctggctggccccggttccggaaaaaccacggtgattaccaaccgcatccgttttctgactgaggaggagggcgtaaccccctcctccattctggtgattacctttacccgggccgcggccacggagatgcagaaacgctatgaacagatgacgcagacaggatgtgcaaagcccgccttcgggaccttccattctgtcttttttatgatactcaaactggcctaccgctacgatgcgggcagcattgtgcgggaggagcagcgggtggaatttctgcgggagctgttaaggcggtacgagatcgagacggaggacgagagcgagtttatctccggcgtgctcagtgagatcagcatggtcaaaggggagatgatcggcgtggagcactactacgccaagagctgctccgccgacgtgttccggcggctttacaagggttatgaggcggccctgcggggcgcgggacttctggatttcgacgacatgctggtgatgtgccgggaactgtttgaccagcgggcggatattttgcaggcatggcagaggaaataccggtacatactaatcgatgagttccaggacatcaaccgcatccagtacgaggtgatccgtatgatggccctgccggagaacaacctgtttatcgtgggcgacgacgaccagtccatttaccggttccggggagccaggccggagatcatgctgggatttgagaaggattacccgggaaccgagaagattcttctggatcagaattaccgctctaccgaacagatcatcggggcggccggccggctgatcgaccacaacaaaacccgtttttccaaggacatcacggcggtccgggggctggggcgctccgtggtggcaaaggagttcgcagatccgggagcggaggccagggccatcgccgcccagctgcgggattacgtgcggttgggagtgccctacgaggatatagccgtgctgtaccgcaccaacatcggtccccgccgtctggtggaggtgttgatggagtataatattcccttccacatgcgggacaaattgccgaatctctacgagcactggatcgccagagatatcctggcctatctgcgggctgcggcgggggacatgagccgggcaaacctgctgcggatcgtcaaccggcccatccggtacatcagccgggacgccctggacggaaagaccatctccctggaggcggtgaaatccttttaccaggaccgggagtggatggtggagcgtgtggagcagttggagtacgatctgaaaaatatccgcaccctgccccctggcaaggcggtgaactatatccgcaaggcggtgggctacgatgattatctgcgggaatacgcgggggagcgccagctggaccctgaggagctgcgggaggtattggaccagctccaggagagcgccatgcctcacgcctctttggaggagtgggaggcgtacatggagaattaccggcggaaactggaggagcaggcggcgtcccggcagctccggcaggagggcgtgcatctcatgaccatgcatagctccaaggggctggagttccgggtggtgttcattttggacgccaacgagggcgtgacgccccatcacaaggctgcgctggacgcagacctggaggaagaacgccggatgttctacgtggccatgaccagggccaaggaccggcttcatgtctattatgtgaaagagcggtaccacaagaaacaggcggtatcgcgttttgtggaggaggcggagattatttgaacggtatggtgcacatttactgcggggacggcaagggtaagaccaccgcggccctggggctggccctgcgggccgcgggcaacggcgttccggtggtgatcgcccggtttttgaaaaatgacgggtccggggaagtggggattctggaaaatgtacccggcgtgtatttgtttccctgcgagcgccagttcgggttcacctggacgatgagcgaggcgcagaaggtggaagcgggggagtatttcagcgggttatttgaacgcgcgtgggagctggggtgtaagacggcgcgagatgaggtggagggggctggaaaggcggatggctgcatggctggggaaaactgggggagcgattctgtgtcagatggttccagtcgacgggatatcggtgcttgtggtactgggtcccccgtttctgggtcccccgtctccgcgccccttacctccccgccctgtgaaatccgggcgctgctggtgctggacgagattatggccgcggtaaacagcggatttgtggcaaacgagcgccttttagcagccctggatcaccggccggacggcctggaggtggtgctgaccggccgcggaccgtctgaggagctgctctcccgggccgactatgtgacggagatgcgggcggtgaagcacccttacgaaaaaggagtgggagccagaaaaggcgtagaatattaacttgcatttttggctatagtctgatagagtgtaaacagaagaacctgtaaaatattacaatttaagagaggtattgaaacatggcagatgagaagaatctgaatgaagaggaagatcaggagatgaccgtcactcttaccctggacgacgatacggaggtagagtgtgtagtcctgaccatctttaaggctggcgagcgcgagtacatcgcactgcttcccatggaaggcgcagattcggaggaaggggaggtttatctctaccgttacagtgagagcgaggacggcgcgcctaccctggacaacatcgaggacgacgacgagtacgagatcgtggccgaggcgttcgacgagctgctggacgagcaggagtacgacgagctggtaggcgaggatgagctggaggaagaagagtaaactgttgcaggacaaatgaatcgatgaatcctatttcccctgtggccggatggctgcgggggatttttttgcgcttgggagaggggaagcggatggaggttttgggggaaatatgtacaacatgtcggatttggtcggggatgggggtgattttctggatattatgtggtaagctataagaatatggaagaaggtgggatttttgtttgaatatttgaaggtaacaaccctggaggcagtatttaccgcaaggggggccgggcggctgccggagtatcttggatctaccatacgcggaatattggggcactgcttccgggattttgtctgcgatatgcgggcaaccaagtgttttgcctgcgaaaaacagtccggttgtccctatgtgcgcaattttgccaacaccggcggacagggaggcgcaatcaatccttatgtgcttttgtcctgcacccagggaaagacggagtggaagccgggagacgagtgcaggttccgcctgacgctgttcggaactgcggcggagagcccgggaatctacattgacgctctgctggcaatggagaggcggggatggggagcggccaagatccccttcgcgctgaaccgggtggtggactgggagacaggcaggctgattttcggagtaggcaggccgtatctgcgcaatctcacgccccacgccatggagatccggcctataaacgccagaagcgtcatggtctccttccggacgccggtgcggatcgttgcggggaaaacgctgtttaccagcctgcccttccaggagctggtgcgtttcctgatgggacgctttgcgcaaatgacccaggcgtatacggactacttgatggagtgggatcaggaggagatgctcaggcaggccacacaggttaagaccgtggccgagcattggaattatctggatttttcccggtattccatcaacagctccagcggaaagctggaactgcccgcccggaccggctgggcgctgtacgagggcgatctgggggcatttgtgccttatctggaggcggggcgttatctgcatgtggggaaaaatactacgattgggtttggcaggtatgaactgtattatgacggagggtttacggtatgacggaacaaacgatgaatcaggcgattgaaaaacttgcagagaattataaccagctggagcagtccctggtgaatcagctccggctgcaggtgccgaaccaccagttgacggttggtacatacagggagcgggtctggaaaagccttttcgagatgatcatcccgaaaaagtattgtattgagcagagtgttttcatcattgactcctatgggaatatctccagagaggtggacctggcggtgtatgatgaaatgtatacgccttatatctttaattatggggaaatcaagtttattcccattgaggcggtagcggtggtggtgcagtgtaagagcggggttaatgatacggcaactacggaaaatgcgatagagtgggtcaatacagttaaagcgctaaagacttcaatggactctgttacaaggactattacggatttggtagataattatgaccgaagcctgcacagcaaaattctcacccagacttcaacacgcccaatcacgatactgtgcgcgacggaaatgggcagatcaatgcggacgaaattgctgaacgaatttgacatacttttgttcgtggaggacatcggcgctggcaaagatgggaagaaaaaggcaaggctggtaaaacagattcctggtgaggagaagaattttatccagtggaatgataatctgaaccattttatgcacagtgaccgggagaaagaagaagcggaatatatgatgggaaggaagaaggatgcgttaaactccatagagtccctaaagaggcgcaacctcacccaactccgcgtcacaaaccatcaagaagaggagaataccatcctgtccctcaccttccagctcaaccagcttctaatgttcctcaacaaccccatgctgttcccgcacagagcctatgcaagaatgtttacgaaaaacctgggcggaaaaatacaggaggattaaaccgtgagtcaatatattcttgcaaaatacgatgtgagtggaattcagagctacattttcgcctcaaggcagctgcgggaaaatgtgggtgcctcccaaaacgtcgggcaaatcctgaaggaaaccctccctggcgtactgacggagtgggcagcgtccagcccggataccgtgaggaccaactgggacaactctaaaaactgggaattttccctgccccaaaccaaggagctgctggcagaaattttatacattggcggcggaaacgcctttgttgtttaccgcgaagaaactgcctacaatcaggtcagcagactgttcgccatgaaaatgatggaacaatgccagggcgtgaccgtgctttccgcccatgtggaagcaaccccggacgatttccccggcgacttgaagcgcttaaaccaggaaatggcccaaataaagcgccgtctgcgccgtccccagcccttgtcctcctatgcagttgtggaacaggacgggttcgacggcagcccggtcacccacctggaaatccgtggggaagcaagcacaaaactatccgaattgcgatatgaaaagcgcagggccagcctgtccaacggcgcaaaaacccagcccgggcggtacgcgctggagatggaggacttggcggaacaaaaaggagaaaacagctatatcgcggtgattcacatcgacggcaacaacatgggggagctggttcaaaaactcatggatcaaaacccaacctacgagacggcagttccggccatgcggcagctttccgccggaatcgcacagcggaaccgccaggccagcgaagccatggagacggcctttgcgtccgtatttgacagggaaccgtttcccctgcgaccgctgatcatggacggagacgacatgacgtttctctgctgctgcaaggccggaatcggggccgcggttgcctgtctgcgaaggctacttcagctctcggatcagaagctgccgctctcgtcctgcgccggcatcgcatttgtccacaatcatttccccttcagcgtcgcctacgatgctgcggaggcgtgctgttccagagcgaaaaaccgctggtaccaggagaaagacgacaaaacggcatacctggattttcaggtggttcagggcgcatttgtaaagggactcaaggacgaagcgcagctggaaacacttagagtccgcccattccgcgttgcggaaaaagtggacctgcggtccgaggattccatcgaccgtctgcgccagaccctggggcggatggcgcccgacggcgggatacaggggcagtggcccatgaccaggctgcgccgcctgtatcaggcgtaccgcttgggccaggatcatgtggatttgttgaaaaaagaatacgcctcccggggttacactgtctctcagctgacaggagagcgcgcaggggtcaccggccggaaggacggcggcatctttgacgcgctggaaacgctggacttttacgacgggaacatttggcgcggcttttgggaagcagttaataaggaggacgctctatgaaacgctggtggcttgaaattacattgaaaagcgatctgtgcgcggcgacaggggacagcgagcaggcagtcacaaatatgaaaacggcgctggaacacggcctgcccatcatccccgccaagcggctgaagggctgtctgttaaatgaaggaaaggaaatcgtttcaaacggctttgcagcgccaaccgaactggccgatctgttcggccgccccggtgcctcccatcccgcccgtctccatatcggagatgcgcacatttaccgcattcccgatttcctgttgggaaaggagcatgcggacggcgacgtggtgctggagaactacgaaaaggagctgagggaactgatccgccatccaaaactcagtgaagatttggcggagcggctccttaccaggctgcggactcgcaccgccattgacaaggagctgaaaactgcgcagaaaaccaccctgcggaccatgcaggtcgtccctcgggggatcgtattccgcagcctgttggagctttcggacgctcagggccagacgccgccgcagctgctgaaatggtgcgtaaaggcgctgcgccatgtgggcctgggcatcacgagaggctatggggaggtgtcctgcaccctcacagagtacatagcgcatgagcaggacgctgcgaaggacagtgggattcccaaggattttccgggcgaaaatgctatggaatacgagatcgagctgcagaatccggtgctgttttccggcagcagagggctgtatgaggattgctgcgactatattcctggctctgcgattatgggcgcgctggccgccatgtacatagcggaccatgggcttggcgcagacgcccaccgggacgaggcattttccagaatcttcctccgggatggagtgcgcttcggaaatggtttcctgaaagccgccgcgggcggccgggacagaaccttttacccggctccggccttcctggcgttggaaaagcggggagagggccggctgatcaaccgcctgaacggggacgatgagaaaaagcggagaaaagaactctccggccagacggcatttgactggggagacggtaaggtttatctggccgatgtggaaaaggaggtcaggctgcaccaccagcgtccaaaggataggggcatcgggcacgcggtcaacgacctcatccaggccggcgcggtggatatgggacaattcttctcctacatgtgcatttctgggggacagcgtttttccggggtgatccggggaaatgccggggatttgcgagagcttgccgcctgcctggagaaacgggactggaatctgaggctgggccgctcccgcactgcggagtatgggaacgccaggatacgcctgttcccggcagggagcggacagcaggaggtcaggtccggccagtgggcgctgtggctgttgtctcccatggttttcgtcggtgagagcggtcagaaagaggcgtcagaacaagatgaatacaacgtatgctccgataagagcggtcagggacggacgttagaagaaaagcatttgaaaaagcagctggaaaaccgtctgggctgtccggtggagatcaaagatgcaattttaaaatacaccagaatcggcggctataacggcaaatggaacctccccctgccccaatatacggcgctggcgcccggttccgtcatctgtatcgaggtgaagaaaaacctctgcaccgcccagctggaatccgaattctggggagatatgaccggtagaggcaacggtcaggtaaaggcattgtcctgggacgatgtcacaaagcccatgaagaactgccaaacggcggcggcggacggtacgaacgccgtggagaagggcgatccggcggcccctggcatattggttttggagctggaggcataccaggagcgggagaaagagcgggaaatgcagcgccgggaggcaatgagcacccaggcagcgctgcccagtgcggtgacaatcgagcagctgattgcgctgatggaggaacatgaggactattcctacacggagcttaaaaaacagatcgataatatacgggatgagcaaaaaaagaacagggcgcaggaatttttgcggccctgtgagggaaagacgcacgagtttatttatttctatttgttgaacagcaaatggagcgcgagaagggaggcggcaggtaatggaaaacaaggaaaatagaatccgcgcgcggattatggttgacatcgatggatacctggacgcgcctctgctggtcgcttccggcgaagacgagaaggcggatatagaccagctgctgactgcggacgggattccatttataccgggaagctccatggccggagtgctcaggtcctatctggaacaggcggcagggctgcgcgaggcggaagcgctgttcggaaccctgggctggacgcagcgccccggtgagaatctggacaaggacggcaaaacccttgaatttcagagccggattctgatatacgatacatgtttggagaacagcgatccggcccggcgggatggcgtccggctgaacgagggaaaaacctccgatgagaatatgaagtttgacatgcaggccgtggaaacgggggctgactgccgtattcggctggaaattattgtaagggaaaatcaggtaacggacactctggacgctgccatcgaccgggatctggccagagtgaaatactgcatcagcggtttaaaacgtggaagtctgcgtttgggggccaggaaaaacagaggatttggaaagctggaggtgcgcggggtgcattaccggacattcaggatggagaaccgcgatgatttccaggcgtggctggattggagctgggaccaggcggacgcctttgacggcagtgaggagtggggcgcagaagcgcttttggcggaaaggccggagggagagcactgcatgcagattcccctcaccctcagcggcacccttctggtccgcagctatgcaaaccccaggtggggcaaagaatccggttcagaaccggaccgggacatgagcgcggattgcgggcagcttacgctcaaagacggcgccgccgtgattccggggagcacttgggccggtgcggtccgcagctacattgcggatttggcgaggcagatcggaggctttggaagctgggaagacgcgcaaaaggcgctggaaccattctggggaacctggagcacaggcaggacccgcaatgcgctgcgcgcctcccgtctcgtgttcgaggaaacgaagatttccgggggccacagtctgccggtgtacagaaccgcagtggaccgtttcaccggaggggccgccaggggagcgctgttcggtgaaacgctgtgggccggagggaacgtgcggctcaccatccgctggcaggagcagggattggacgaactggaaaagaaggcgctgcccggtatgcttttgtgggcggctcaggggcttggcagcggtctgttgactgtaggcggagaaagcggagccggcagagggatatttgaagcggaaaagagcgtgcttctggacggagagcctgtggagaaagaggaagcatatttgcaggcggcggctcgctggtgcagacggcagaaggaggtacaggatgggcaaaatacgccagattacgtccacatgcgtgcgcgatgaggcggaattgacacaggagcagattgaggaaatcgtgagggaggaatttccgggggaagccgggctttacctggaaatggacgatcaggtccttctgggcaggtacgaccggggaacctggcaggtccgcacagacggccaggggattcagaatgcttttctgtgggaaaatgtgcagaaaatgatcatattcgacgaggaacaggagctcaggttggttcgccgcggcctgcatttttgcggaaggctgcgccgcgacgggatctgcaacagcctggcgtatgtgatggacgaggaacagaaaatgtggggagaagggcagagggccgacgaggcgtggagcgtgcttaagtcaagccggggcgcttcgatctgggtaccggaagtgctgggaagagtcggcggagcgataggcctgcgggtccgcaaatactatgaattcccggatgcaacggaaaaacgcggtctggtgtcgcagatagacgaacggctgttaggcttctgcccgtggccggataacagggggtgtgtatagtggaatattttacaaatccatacaattttgtgccgtttacgggaacctgccggcgggagccgctgaacctggggcctcaggagtgcatgaccggctactttgaatgcgagctggagcttctgaccccgctgttcattcccaacacctccaacaaatatgccctatgcaacgaggaggagcaaagtcatcaatataccggatacgagttctgttcctacgaagacctctccgggaacacccagccaggaaagaccggccccaaagacccggtgatccctgggagcgaaatcagggggacggtgcggagcgtgtatgaggcggcgtttgggggatgtgcgtctacgatgcgggtagatacggttgtgggacaggagattcctgagaaaacatatccgggggttttggtgagagaagcggaaaacaaatgctgcttcataccatgtaaacgcgcgacgtttaatgcgaggcagtgttttagagagggtcaggaaatctgggtcaaactggaaaaaatgtaccacgatcagaatggcaaatcattttttaatatgagcgtgaaggattatcagataccggatggaagaaacaaaccctctgattattatcgggggtggattcacaataagaaatcgtctggtggaaaatatccatataagtatgtattttattgcgcggatgagaaggcgaaagagctgatccagacggaagaatatgaggtatttgagcagatcgtcaagagctgccgaggtgaagttgcgcagcctggattttcagaaagcaatagctgtattccagtctattatgccgaggaaaagaataaacccagatacctgtctccggcctttctggaacgaaactgttatcagaaaacattagaagcgatcctgaaagagaacggaggttttcagccctgtgtctctgccatgcagatatgtccgtcttgcaaggtatttgggatggtttcacgagagcatggaaatacaggctcagtcaatactagagtgcgttttacggatgcccggctagatgaagatatggggaaagaaaacgctgtaaactgttatggtgattacatgatactgcccgaagttggagcaccgcatccagatacagtcgagttctatacggaatcgccctacgaggataatgaaaagaaatactggaaaacagaaggatactggacatatgaccatgtacgtgtcaaaacggatcaaaatgaataccttagattgctgccaccatcactacctaaattgagggggcgtaagttctattggcaccatgatggatggaaaaaactggataaaagtgaactgttggacaaccagcttaagcagcggatacgtcctcttcttccggggaaggagacaggaaggaagcaaacatttcattttcgggtgtattttgataagctaaatcggaaagaactgggacagttgcggtggtcgttggattttatggatgaagtctgcgcccataaggtcggaaggggaaagccttatggtctgggcagtgtgcggataaaaatctgcgatttggaaattcgggaggttgacggagatacaggaacggtgaaactggtgagaaaaaactataaggatttggggatggatatagcgacggaatgcgagccggtaaaaacattgaaaataatggcctgtgcagaacctctccgccacgatgtcagttatccgcaggtggagggagacgaaaaggagtcgtttatttggttcaacaataacaaaataaatgatgactcgaaaaagcagcaaccagcattttcaaaaatacttccaaagccagaggaggaactggatacaaataatagttctggaaaacgtctgcatacgaaaaaggcaaccccaaaagcataccaccgtgcgaaccctaagcgcacataaaaaccccaggacattcgcaccgagattaggaggagaaagaggaggaaaaagaggagaaagtgtgaagaggggttgatttgttggagggaatgtgtagaatatgagataagagtatcgagatttgtgaggaaaaattggtgagatttgctgtcacagcctgcgaaggctgtgtggattgaaatcagacgatggatgcggcagctattgccaacggcgggtcacagcctgcgaaggctgtgtggattgaaatcattatgtcctctggctccgccacctcctcctccgtcacagcctgcgaaggctgtgtggattgaaatatcagatttttgagatagaggataatatcgagcgtcacagcctgcgaaggctgcgtggattgaaattaccatttggtaaaaactaggattgctgcccatgggtcacagcctgcgaaggctgtgtggattgaaatttgggaattatggcaagcgaaggagggcagcgggagtcacagcctgcgaaggctgtgtggattgaaatgaatccattctttttcaaaagatctgcacaataagtcacagcctgcgaaggctgtgtggattgaaatcccccattctgtaccaaacattatttcgacattggtcacagcctgcgaaggctgtgtggattgaaatgtattctacaggaggaaaatatatggctgcgggtagtcacagcctgcgaaggctgtgtggattgaaataccagacattagatattctatgcttacaccaaaagtcacagcctgcgaaggctgtgtggattgaaatatctaggctgttggccatgccgtatccaccattggtcacagcctgcgaaggctgtgtggattgaaatggatcaccgttaaaacactccacccatatctccgtcacagcctgcgaaggctgtgtggattgaaatcaactcaaatacatccatgcgacggagtacgagaagtcacagcctgcgaaggctgtgtggattgaaattggacatcgtgtgaatttcattcaccactggtttcgtcacagcctgcgaaggctgtgtggattgaaattctgaattgctccgtgaaaacacactgagtaattgtcacagcctgcgaaggctgtgtggattgaaatctgcttctctgcaaacgtcaaagactttcaacagtcacagcctgcgaaggctgtgtggattgaaatagagctgtttgatatcgtatctcctggaggggaagtcacagcctgcgaaggctgtgtggattgaaatattttgacgtggattcagccacgttgtatgaaaagtcacagcctgcgaaggctgtgtggatgagtgtgtgaaaaaaagtctgtaaatgctgatcttctatgataatcactgggctgaaagttcctttttggactttcagcccttgttttatatataacagcaactatcgttgtatgtcaagagcaggcgaatattccgcctgtgaaaaataagacagattggcttattccggcagacggccctcatacatgatgctcagttcaccatatacctgtccccaattcctgattggcatggtccatttctttgtagcttcaaacgtagacaggtacaaggcttttagcagtgcggtatcgcttggaaacacgcttctctgacggttcagcttacgataagtggcattcaggctctcaatggcgttggtcgtataaatgacccttctgaccgctgtggaaaatttgaaaatcggggaaatggcatcccagttttgtttccagctcctcatggaattgggatatttttcgctccatttttccgtcacccgctccagggcgtccagggctttttcttccgttggcgcctgatagattgttttaagatccgcacagaagggcttcctgtctttgtccgacacatatttcatggtgttacgcacctgatgcacgatgcagcgttgatattccgtctttggatacgctgcggcgattgcctctttgatgccgctaagtccatctgcgcagagaatcaagatgtctttcactccccggttctttaagccatttagtacagacagccagtatttagagctttcgttttcgccaacctcgatggtcaggacttctttgcgtccatccggattgatgccaagaatcacataagccgcaagcttgcggatcaccccattatcacgaactgagtaatggatggcgtctatgtagagtaccggatatacctcggaaagcgggcggttctgccagtcttcaatctgcggcatgattttatcggtcacatccgaaatgaacccttcggatgcctcaaaaccataaatatcctccagcgtatcagaaatctgccttgtagtcatgcctttggcatacatggaaatgatcttctggtcgatatcggagatatctttttggcgttttttgaccacctgcggctcgaacgtggatttacggtcctgggggacttgaatgtccatactgccatagctgctattgatgcgcttaggcttataaccattacggtaatcatccgtgtccgaacgttctgatttttcatagcccaggtgctcatccatctctgcttccatcatttctttaattgtgccgccaagcagatccttgagagcatcctgaatatcctctgcggactggatgtcatactcctgaaggagctgctggataatgttccttttcccatctgtcatttgtactttgtgtacgggtttcttttctcttgccataataaaaggcctcctatgatttttattttaccatagaagaccttataaaaccttagttacagaaaaactttcacatactcgtgtggattgaaataccatcgcccctgtttcaattcccagtgctttgcgtcacagcctgcgaaggctgtgtggattggaatacacagttggttgcctaatctattagccgatgactcacagcccccgcctttattccccctccatccaccttctacccaaaccccgcccctcacccccaaaaccccccaacatttcaccaaaaatttcccctcatcaggatacttcctcccaaaatccggtacaataaacactagaccggaaaaggaggaacccaaaatgaatgactcaaacaaccattgcacaatcgatctccaaaccctatctcaataccaacaacacctctacgaacaggaaaaatcccaccctacaatccaatcctacctgcgcagcctcaaggtatttgcagtctttttagacggccgtccatacaccaaagaaactgcgatccgctggaaggaaaccttaactcgccgctacgcccccaacaccgtcaacgccatgctggccgcaatcaacggctttgccgaattttcaggctgtccgcaattcaaagtaaaacccctaaaaattcagcgcgagctattcatccgccccgagcgcgaactgacacggtccgagtacggccgcctggtaaacgcagccgaccgcagtgggaaccgtcgattatccctggtgctccagaccatctgcgccaccggaatccgggtatccgaactgcgctttatcaccgcagaggcggtggaaaagggatatgcccaggtggactgcaaaggcaaacggcgcactgttttcctgccggaaaagctgcgccgtctgattggaatctatatgaagaaacaaaaaaagaccgccggagcggtatttataacccgcagcggacggccacttgaccggagtaatatctggcgggacatgaaagcgctgtgtgagcgcgccggagttgaaccgggcaaggtattcccgcacaatctgcgccacctgttcgcgcgcacttattatatgttggaaaaagacttatcccgcctggccgatattctggggcataccaatgtctcaaccacgcggatctacactgcggagagcggaacagtccacgcccgccagatggagcggatgggacttgtgatcacataatttcccttttgttgtaatccggatacgcgttcgaacaaaattacatacccagtatactacaccaaaagtcattttacaaccaaaacagacgcaggtgggacgggagggcgcgaagacaagaccggtggttatgccagcagcaaaccggtctctgtttgtgtgcttaatcgattgtccggacgtgagacggtgggaacgccgcctgaattacaacaaaagggaaattttgttgtaatccctgtccgcggagtgaggaaagggtgggatcatttatggaagcgcaggagttttgccgtttcatttggcacatatatctggagaaaaaggattaccaggcactggagaacctgctggctccggatctgtccgtgatcggaacgggcgcccatgaactctgccggaaccgggaacaggccttgcgtaagctgacggaggaagagccgctgtgggacgggcatttttccatcaccagccagtggtaccagactacgccccttggggaggaaacatttctggtcatcggtgagctgaacctccggcagatatcgtcccagcctctggcgtacaacgccggattccgcttttccatggtggtgcgccgcgcgccggagggctggcagctggtccacatacaccgctccgtacccgatccggagcagatgaagggagagccctacccgcgtatcctgctccagcagagcaacaggaagctggaggagctgctggaaatccgcagacaggaattggaaaatgccaaccgggaggccctctactacgcccggtacgattatctcaccgatctgatgaaccgtccgtttctggagtcggaggtgcaggcactgatgcagaaaaaaccgtacggcgccatgatgatgatggatgtggatgatttcaaacaggtaaacgaccggaacggccatccctttggggatcaggtgctgagcctgctggccgagagtctcaaggcttcctttaccggctgcctcagcggccggatcggcggggacgaatttctggtttacaccggaggggatgagccggagatggaggaatttctggaaatggcgcgggcgttttgcagggactgggactgccggcagaaacgtctgggcctggaccgccgcatcagcatctgtatgggaattgccctgtatccacaacacggagataactatgagagcctgtggcagaatgccgacaaggccctctatatttccaagcgcagcggaaaatccgccatcgccatcgcggatggccgtagccttcgggaggacctgtgaaatctctgtgaaatggtagaaatgtgcatgtctttttgctaaaatgttattaaacaggtaagaatgagtgcaaggaggcattgtgcatggaatcattgaagatactggtggtggacgacgaagccagaatgcggaagctggtaaaggattttttgaccaataaaggatttcaggtaatagaagcaggggacggggaagaggccgtggatattttctttgcggacaaggacattgctctggtgctcctggacgtgatgatgccgaaaatggacggctgggaggtgttaaagacaatccgcaaatactcccaggttccggtgatcatgctcaccgcccgcagcgaggagcgggacgagctccagggattttccctgggagtggacgagtacatttccaagcccttcagccccaagattctggtggcacgggtggacgcgattctgcggcggagcaatgtagtttccaccgatactctgaacgtgggcggaatttgtattgacaaggcggcccaccaggtgaccattgacggcagtgaaattgagttgagctacaaggaatttgagctgctcacctattttgtggagaatcagggcctggccctttcacgcgaaaagattttaaataatgtatggaattacgactacttcggggacgcccggaccattgacacccatgttaaaaagctgcgcagcaaaatgggagagaagggcgaatacatcaagaccatctggggaatgggctataaattcgaggtgagcgattgatgaaacattccatacgcggacgttttacgatgatattcgtgggcctgatggccgcggtgctgttcaccacctgggcggtgaacagcttctttttagagggattttacacccgccagaagttgaaaatcctggagcgcgcttatggtctgattaaccagctggtggtggagaaggctgacaacggggaatccctgaccgaggaccttcagagcctgtactcagccgacggagagcagacggaactcagccgcctgctccgcctgatgagcgagaaatacaacaccaacatcgccattgtggacagtatgaacgacgacgccatgccttccgccagggacgcccgttttttggcggaccgggtgcaccagtacatactggggcgcaacaatcccggtaccgaggtgctggtaaaccaggataattataaaatccagaagagctacgaccgccattcccaggcatattatctggaaagctggggattctttgaggacaaccggaccattttcatcatgtcaatgcccattgccagcatccacgacagcgtggcggtctccaataaatttctggcctacgtgggactggccgccctggtagcaggcagcgcgctgatgtattttaccaccaaaaaggtaacatcccccatcatgtccctggcgtccctgtcggcacggatgtcggagctggactttgaggcgcgctatgaaggacggtccgaggatgagatcggcgtgttgggccgcagtatgaacaccttgtccgagaagcttaaggagaccatcggggagttgaaaaccgctaacaatgagctgcagcgggatattgaagagaagattcgcatcgacgagacgcgcaaggattttattgcaaatgtgtcccatgaactcaaaacccccatcgcgctgatccagggttatgcagagggactgaccgaagggatggctgaggacccggacagccgggattattactgcgaggtcatcatggacgaggccaacaagatgaataagatggtcaagcagcttttgaatctgaccgctctggagtttggaaatgatctgccggtgatggagcagttcgatatcacagcgctgatccgaggaatcctctcatccgccggtatcctgctccagcagaaggaggccaccgtggtgtttgatcaggagactccggttctggtttgggcggatgaatttaaaatagaagaagtgatcaccaattacctgaacaacgcgttgaatcacctgggcggagagcgctgcatcgagattcggctggagaatttggggaaggaagtgaaggtatcggtgtttaacacgggaactcccatacccgaggaggaactggacaagctgtggacaaagttttataaagtcgataaggcgcatacccgttcctacggcggaagcggaatcggtttgtccatcgtcaaagctatcatggactcccacaacaaggagtgcggcgtggaaaacagaccggatggggtctccttctggtttacagtggacggcagttccggctgagccggtaaccggcagaaatccactgtattgtcggaaaaatacgaactaaagaaaaaatttaaaaaaattgaaaaatagtgttgacttttggggaggggtttggtattatatctcttgcgccgctgagaacggcaggcgcaagagaaaaaaataaaaaagttgttgacaaactgaaaacagcatgataaaatatcaaagctgtcgacaagaaacaacaacacagcaaaaaagtttttaaaaaagttgttgacaaacgctagcgagtgtgctaagatataaaagttgctgctaacgaagaacaacaacagagaaccttgaaaatcaaagattgaacagtatgtaaaaccctgaaaattctaaaaaataaaggtctggtttagacctttggatttgagaaaattcagaacaaaaccaagtaatgaaggttaaagataactagccaagctaagtagtctaagaccaagaatcaacttttaatttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaagaagaagtaagggttttatatactgttgaatcttggatttatactaaggttccaaatttctggtgctgatgcgcttgggggaaacacccgttcccatcccgaacacgatggttaagactcaagcggccgatggtactatgctggtgacggcatgggagagcaggtgagtgccagatccttttgggggtgtagctcagttgggagagcacctgccttgcaagcagggggtcaagagttcgaatctctccatctccattcaaaatcatccaacaaatgattttgcacacgtaccttgaaaaccgcatattgaatgaaaatgaattgaatattctatagaataatcaagacatccgagggatacatcgaaagatgtatcaaatgtaacaaacctaagaccaaacgatccaacgctatggattgtcgatgagtcggagcaacccgcaccgacgagtcattttggttaagctataaagagcgcagggtggatgccttggcactaagagccgatgaaagacgtgataagctgcgaaaagcttcggggaggagcaaatatcctttgatccggagatatctgaatggggaaacctggctgagtaaccctcagtcgacgtatggtgaatacatagccatacgctgggaacccggtgaactgaaacatctaagtagccggaggaagagaaagaaaaatcgattcccaaagtagcggcgagcgaaatgggaagagcccaaaccagcgtgcgtgcacgctggggttatggactgcataagcgagctgattcgttagtggaactgtctgggaagtcagaccaaagagagtgaaagtctcgtacacgaaaacgataggcagcggcaggatccagagtaccacgagacacgtgaaaccttgtgggaagtcggagggaccaccctccaaggctaaatactccttagtgaccgatagcgcatagtactgtgaaggaaaggtgaaaaggaccccgggaggggagtgaaaaagaacctgaaaccctgtgtttacaagctgtggaagcacgttaaggtgcgaccgcgtactttttgtagaacggtccggcgagttgccggtactggcaaggttaagtggttaagccacggagccgaagggaaaccaagtctcaaatgggcgtaaagtcagtacaggcagacccgaaaccgggtgacctatccatgtccaggttgaagcggaagtaaaattccgtggaggaccggatccacatccgttgaaaagggtgggaatgaggtgtggataggggagaaattccaatcgaacccggagatagctggttctcctcgaaatagctttagggctagcctcatattagtttagcggaggtagagcactgaattcctaagggggcgtcaaagcttaccaagggatatcaaactccgaatgccgtataaatgatgtatgggagtcagactgcacgagataagttgggtagtcaaaagggaaagagcccagacctacagctaaggtcccaaagtgtgtgttaagtggaaaaggatgtgggatttcagagacaactaggatgttggcttagaagcagccacacattcaaagagtgcgtaatagctcactagtcgagaggtcctgcgccgaaaatgtccggggctaaaacacaacaccgaagcttaggaatcacttttagtgattggtagaggagcattcttaaaggaacgaagcagtaccgacaaggagctgtggacttttaagaagagagaatgccggaatgagtagcgagatggaggtgagaatcctccaggccgaatatccaaggtttccagagtaaagctgatctgctctgggtaagtcggggcctaaggcgaggctgaaaagcgtagtcgatggacaacaggttgaaattcctgtaccgcgtattatcagaactgtggggacgcagaaggacaacacaacccgggaatgggaagaccggggcaagcgaggtaggagtatggttggcaaatccgccgtacaatccgaagacgtgacgcgtagcgaactataagtagcgaagtgtgtgattccagctgccaagaaaagccgctattgtgtaatacgtgcccgtaccgtaaaccgacacaggtagatgaggagagaatcctaaggccggcgggagaagcattgttaaggaactcggcaaaatgaccctgtaacttcgggataaagggtgccagagagatctggccgcagagaataggctcaagcaactgtttagcaaaaacacaggtctatgcaaaaccgaaaggtgaggtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagcttgatactgggattcggtattgcatgtacaggataggtgggaggctttgaagcaaggacgccagtctttgtggagccaatgttgggataccacccttgcgatattgggtttctaacctgcagccgtgacccggctgggggacaatgtcaggtggggagtttgactggggcggtcgcctccgaaagggtatcggaggcgctcaaaggttccctcagaatggttggaaaccattcgcagagtgcaaaggcataagggagcttgactgcgagaccgacgggtcgagcaggtacgaaagtaggacttagtgatccggtggtagaaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcgtaggatatttgagaggagctgtccttagtacgagaggaccgggatggacggaccgctggtgtatctgttgggtaccaagcccatggcagagtagccaagtctggacgggataaacgctgaaggcatctaagcgtgaagcccccctcaagatgagatatcccatagcgaaagctagtaagaccccttgaagacgacgaggtagataggttagaggtggaagtgcagtaatgtatggagctgactaatactaatcggtcgagggcttaaccaaaacggtataggttttaaacatcattcaatatgtggttttgagggtacgtttaaattgataatttcataatttattcgtaagcggtgatgacggggtgtggctcagcttggctagagcgcctggtttgggaccaggaggtcgcaggttcgaatcctgtcaccccgacgaatacaaaatatgcgcgagtggctcaggggtggagcaccaccttgccaaggtgggggccgcgggttcgaatcccgtctcgcgcttttttatttgcagcggaaaacttgtaaaatcaaggtttccgctattttttgggtggtgctaaaattgtagacagatgtagatagttcgcgcactgtttaaacgcttgtcagatttggaaatttgtactataatgggcgaaatgagctgtaaaagcagataaagatgtaaaattaagaagggcgagatcatagtatgagcggtttgggaacggttgtgaatgtggcggcgattctgggaggctgtgtcatcggacttttggtgaagggaggacttccgaagcacctggaggacacgattaccagcgcggtggggctgtgcgtgatttttgtggggatctccggtgcgcttaaagggatgatgaccgtcacggccgggggactggatacacgggataccctggtgatggtgctctgcatggtgatcgggtccactctgggcgagtggatcgacatcgaggaccggttggagcagctgggaatctggtgcaagtcgaaaataccggctgggaaggcctcgggcacctttgtggaggcatttgtgagcagctccctgctgttctgcgtgggggccatggccatcgtgggagcgctggaggatggactgacccataactacagcacgctgtttaccaaagcggtgatggacggcgttctctccattatttttaccgcggccttaggcatcggcacggcgttttccattttcccggtggccatctaccagggctccatcacgctgctggccggcgtggtgcggccgtatctgaccgagctgatgatcgggcggatctccttcatcggttcgatcctgattttcgctctgggactgaatttggttttaaacagcaagctaaaaatcggcaacatgctgcctgcagtttttctgccggtgatcgtgtgcctgctgggatattgacgaggaggatgaggacatggaatttgcaaaacggatggacctctttggcgagggaatcttttcaaagctttcggaagtgcgcaggcgcaagatgtctgccggggaggcggtgatcgacatgagcataggcgcgcccaacattccgccggccgctcatatccgggaggctctctgcagggccgctgcggaggagaagaactatatttacgccatcaacgaccagaccgcccttctggacgcggtggccgcctggtatgaccggcgctacggagtgaagctggacccgcagactgagatctgttccctgctgggttcccaggagggcctggctcacatcgcgctctccatcgtggacgagggggacaccgtgctggtgccggacccctgctacccggtgttcggggatgggcctcggattgcaggggcaacgctctattatatgccccagaaaaaggaaaacggttatgtgatccgcctggacgatattcccggggaggtggcccgcagggccaaattcatggtggtgtcttaccccaacaatcccacggcggccctggctccggacagcttttacgaggagctggtggcatttgccaagaaatatcagatcattgtgctgcacgataacgcttacagcgagctggtgtttgacgggaagagctgcggcagctttttgagcttcccgggggcgcgggaggtgggggtggagttcaactccctgtccaagacctatggcctggccggggcgcgtatcggcttctgtttgggcaaccgggaggtggtggcccaattaaagcggcttaagtccaacatggactacggcatgtttctgcccatccagcaggcggccatcgcggccattaccggggaccagtcctgtgtggagagcaccagggaggcgtacgcccgccgccgcaactgtctctgcgacggcttcaccgccatcggctggcctatggagcgccctgcggccactatgttcgtgtgggctgccattccgtccgggtatgagacctccgaggcatttgccatggatctggtgaagcgggccgggctgatcgtgacgccgggcagcgcctttggtccctccggcgagggttacgtgcgcctggcgctggtgcaggatgaggatgcgatccgccaggcggtggatatggtggctgccagcgggattttgtcaggtgggatatcgagggttggacgttaagccagaaagaaattgatgaaatgatgagaaggtgtttccaaagtttagaggtgactttggagatgcctcttttttatgcccgttatcgggtgggattgtctatataaatgactttatgtaaataacaaaatatcgttcattgcttccagtaatagatattatagcgtgtttctgcattttctgtcaagaaaaatgctactataatgcactgcaagtcccttggagggattggtgatattcgcaacagtttgtgccaaaatagtttcgtttgatcatattgtggatgaaaaagaaacagatccggctaaaatatgatcatttaactttctataatatctattatatgaagtttctgatttgaggaatgttcaggatacaggcagagcaggacgggagaaatgtcactcgtatgttgaaaacaaaagaagaccggggatgtccgttatggacagacttcggacgagagggacggtattaagttatgtgctatgtgatgacccaggatcttttactccggtacgatcattatcttggagcgaacggctattcaaaggcaacctgtcaaaaatacaagggggatttgcagcagttttacaattatcagggcggtgaaacagtggatgaggagacctgccgggcgtaccagcgctatttgttggagcattacacacccagaggagcgtgttccaagattgtggcagtcaatactttcttccgctttgcggattggaaggtgcgcatggacgtgcccaggatcaaccgaagcacggtttccaacgcagggatggagctgactacctcggaatacaggagcctgctaaacgcggcaaagtctcagcgcaatccgcgcctgtattatctgatccagatattggcgttgaccaagatcagcgtcagcgagcaccagtatattacacctgaggccgtagagcagggatttttcctgattccccggggaaacagtagcaaggtggtagtattgcccaacgcgctgcgcaaggagctggctgcgtttgtggagtccatgaaaataaaagaggggccgattttcagcagccggaccgggaagccctgggatcgggcggcgattcacaagagcttgaaacggctgtgccgggggacgaaaatcgatccggaaaaggtcacggccaggaaccttactcatgtgattgcgttcggggcggcggtctataagctggacgagagagtgaaacatataaacggggcgcaggataaagatgaacattaaaggatcggagccggcaggtggcattttactctgccggctcttgccatatttgaaaaactgtactataatgggcaaaataagcgtcttaaacagaggtggacatggcggtaagaatgagacaggtgagggaagtttggcatagcgggttgttctggcaggcggcactggcgctctatgtgctgttcgtgtacggccactccatggttccggcggagttgtcctcccgggagagcggcgcggtgctgcaaatgattgccaaaatttgggacgggctccatttaccagggcagatgcccacagagcatatgcttcgcaagacagcgcattttttggaatatatgggaatgggtgttctgttgtgcaggaatatccaggttatggcgcggcagcggcggattttgctgcggtcggtgattgcggcggccatatggctgccgtttgtggacgagaccatccagctgtttgtgcggggaaggtccgggcagatcagcgatgtctggctggacctggccggaatgtggaccggtctgggcctgatgtaccttttggggcgtgcgaagtcacatggaaacaggaggcggctgagatgaattataaaatgatcctgcagtacgacgggatgcgctacgacggctggcagaagcagggcaacacggaccggactatacaggggaagctggaggctgtgcttgggcggctggcggaggagacggtggaggtccatggctccgggcggaccgacggcggcgtccacgccagaggacaggtggcgaattttcatctgaaacgagcgcgggaaccggaagagattcgcgcgtacctgaaccggtatctgccggaggatatctgcgttctggagctgacggcagccccggaacgttttcacagccgcttaaacgcctgccggaagacttaccggtaccagatttggatggacggcaagacggatgtgtttcagcgggattatttctacggcctgggtaggcagctggatatcggacagatggagcgggcggccgggagtcttctggggactcatgatttcaaaagcttctgcgggaataaaaagatgaagaagtccacggtccgcaccataacggcgatccgttttatccgtatgtgcgatgggaaggcgctggctgtggatttcacgggcaacggctttttacagcagatggtgcggattctggcggggacgctgatcgaggtgggcttgggaaagcgggaggcggatagtctggaagccgtattggaattaaaggaaagaagtgcagcaggatttacggcgccgccggaggggctgtgcctgatgaatgtacagtatgaggaagagaaatgacggaatttttagtaaaacgatttgtaaaagattaccagcagacagaggcagtgcaggttcgcactgcctatggtacgctctccagcatggtggggattttctgcaacgttctgctgtttggcgcaaagctgctgattgggctgctgattaacagtatttccgtgatggcggatgcgtttaacaacctttcggatgcggcatcctccattattgggttcattggagtcaaaatggcggaaaaaccggcggacgacgaccatccctttggacacgggcgcatcgagtacatcgcggcctttatcgtggcgtttattgtcatccaggtgggattttcgctgtttaaaacgtcgctgaacaagattttgaatccggagagcatgtcctttaagtggatttccattgtgatcctgtccctcagcgtggcggtgaagctctggctctcactgttcaacaggacgctgggaaaacggatcaattccaaggtgatgctggcgacttcggcggacgccatgggcgatgtggtcacaacctcggccaccatgctgtccatcgcggtgttcggcatctttggcgtgaacattgacggcatcgtggggattgccgtgtcggtggtggttatgatcgcgggcgtgaatatcgccaaggatacgctggcgccgctgatcggcgaggccatcgatccccagctgtacgaacagatcaccaattttgtggagagctttgagggcattttgggaacccatgacctgattgtgcacaactacgggccttccaagagcatggcgtccatccacgccgaggtgccaaacgacgtgaatgtggagcgctcccacgaggtgattgaccagattgaacacgaagcggcaaggcggttcggcctgcttttggtgatccatatggatccggtggagacccatgacggccggatccgggagtttcgggatatgcttggcgaggttctgacggagcttgacagccggttgagctttcacgacttccgtatggtggacggggtggagcacatcaatttaattttcgatttagtggttcccagggaatataaagcggcggttcaggacaacttaaaagcgaggattagcgcagcggtccgcaaacgcgacccacgctgcgcctgtgtgatcacggttgagaacagctatctggcggaggcgcagaaataaggctaatccctgaaaggggatccacatgacggaggaagcgctgttaaaggagattgcggccggaaatgaggaggcgttcagacagttctatctctgcacggtccggccggtgcacagctatatcctgtcgctgacccgaaacagccacgaggcggaggatgtgctgcaggaaacctatctgaagatttggactgatgccgggcaataccggcctcagggcaagccgctggcctgggtgttcaccattgccaggaatttgtgctatatgcggtttcgggaacagcgcaggtgggcggagtttggactgtctgagctggaggactgcgaggaggggaaaaactgcgaacagatcgaccaggcggcggaccgccaggtactgctgcgggcactggacgagctgaaggagcaggaccgtcagatcgtgcttctgtacgcggccgcggggatgaagcatcgggaggtggcaaaggccctgggactcccgctggccacggaactatcccgctactcccgctcgatgaaacgccttcagcagcttctgacagtgcggcggaccgggggctgagggccgatccgccggtctgaaacgggccgcagaggcgctgattttgggacagagccggggaacggaaaaatgtggtaaaaaaatgaaaaaaaatgaaaaatccccttgcaataaatgaaaaattattgtataatatatttcgttgtgttgatgggctatcgccaaatggtaaggcaacggactctgactccgtcattttcttggttcgaatccaagtagcccagctgtatggacccggcgtttttcacttaggtgaaggcttccgggtcttttttgcgtgtaatgggttatttgcgtagtctgcggtttttggaagatcatgaaaaaagggggggaaaatgtcatccccaaagtgtctattatatggtataatcaatacatgacagtagagtgttgacagaacgattatgttgacaggggtgtgtttgtggatgtataaaaatgtttcaggaaaagtgtatatcaagacgttcgatggatttgatctgtataaggatggaaagatggtctatttttccagcgcaaaagccaaagaattgcttgcatttctggtggaccggaaaggccggtttgtgcccctgagtcaattagcggaaaatctgttcgagaatgaaaaggatatccgaaaggccaaacgtttggttcacacggcgtttaaccgcctgaccaaaacgcttaagagttatgagatcgaggatattttaaaaagaggaagaggggtttacgcggtcgactgcagccggattctgtgtgacagctatgagatggaagcgcacacagaggggagcagcaatttttttctcggcgagtatatgccagagtacagctgggcggaggtgacgctgtccaatctgctgagaaagtattacgatgaaaatcagctgccggaccacgagggggactcgtaggcggaacaaacaggggaacgatgggaagacataaccacagtcaggaattgtggttatgtctttttttgatgcaatcaaccgtgggcagggccagggggagaatgttctgttcggatttcagatataatggcatgcggataccaaatctaaatattgtgacctttttaaagacgtatcttctttttttcatgcaaaaaaacgtattttttacaaaaaagtacaaatattaaaagaaatacaatttatgggtgaaaccggctgcgtttgtaactaaaatgtaacgtttctgtatccaacgtcatgatataccgttacacgaaaggccacaattatttacacataatgaggtgtagagatgaatagaggggaaagacgggtgtatgtcaagacctttgacggctttgatgtatacgtggatggcaggattgtttacttcccgagtggcaaagcaaaagagatgctggcggtgctggtggagaaaaagggcagcagcgtttctctggcacaaatggcgtatctgctctatgaaaattcggaggaaacccgtgccagaaatacgttgcgggttgtgtaccacaggcttcacaggacgctggcagaatatgagatcgcggatattgtcatcaaaaggcggggcagctatgcggttgacaccgaccggtttgtctgcgatttttatgaattcataagggagcagccggcgtttttgaacgcatattccgggacctatatgccggaatatccgtgggcgaggaacatgattccttatcttgacaacctgtaccgaagatactccggtcagaagttaaaggagtaaccaaatggaattaattgatatccatgcacatatccttccgggcgtggacgacggatcccgcggcatggaggagtctgagacaatgctgtccatggcataccgccaggggatccgccgaatcatcgctacgccccattattccagaagaagagggagcgggggactggcagagctggcggaccgactgaacgccagggcccaggcgatttacggagattttgaaatactaccggggcaggagacctattattatgagggtttggcagaggccttgaagagcggccaggcgctgacgctggcgggcagccggtatgtgctggttgaattcgacccgggcgcgtcctaccggcagctctaccagggagtccgcaagctgattatggcccggtatgtgccggtgctggctcatgtggagcgctatctgtgcctgcgggacgagggcaacttccgggagctggtccagtgcgactgccgtatgcaaatgaattatgacagccttgcaggtccgttttgggatcccggcgtgcggtggtgcaggaaaaaggtggagggcggctgtatccatctattggccacggatatgcaccgggtggactaccgcaagcccgatctggaaaagcccatggcatggctgcaaaagcatgtgggggagcgccggctgcgggccatggtgtgggacaacccgcttgcgattatgaaaaatgagagaatggggtaggtacataagagatggaaacgtatatgaatgacaatgaagagattgagattgaccttttcgagctgttcatggaactgaaacggaaaatatgggtcatccttggggtggcggttttgtgcgccggagctgcgggcgcattcagcgcgtttgtgctgaccccgcagtacacgtctaccgctatggtgtacattctctccaaagagaccacgctgacgtccctggccgacctgcagattggcagccagctgacaaaggactacaagatcattgtgaccagccgcccggtgttggaggatgtgatcgaggggctggagctgaacactacctataaagatttgaagaaaaaaatcaccatcgacaacccggcggacacccggattctgtccatcagcgtgatagacccggacccgcagatggcaaaggccattgcggataagattgcagccaccgcatcggattacgtgggggatatcatggagatggtgccgcccaagctgattgaggatggcgaagtgcccctcttaaagacgagtcccagcaacacgaagaacgccctgatcggagggctggtgggcgcgctgctggtgtgcggcgttgtcacggcgcgggtggtattaaatgataccgtccggacggaggaggatgtgacccggtacctgggcctgaccgttctggcctctgtgcctgcgcgtaagggggagactccggaggacaaggaagccatggtgtcctcgaagtcccgcaaaaagactcagaccccttccggaagatccaggaagaagaaaagggaggaaaaagtccgatgagacagacggttgctctgaaccggagcatgaaggatgactaccattataatgaagcgatcaaaactctgagaaccaatatccagttctgcgggagcggcatccgggtgattatgatgaccagcgctctgcccgacgagggaaagagcgatatggcatttgccctggcctcatccctggcccagatcggcaagcgggtgctgttaatcgacgcggacatccgaaagtccgtgcttgtatcccggtatcagctggaggatgaggtctgcggcctgtcccagtatctgagcggacagaagcccctggaagagatccgctatgccaccagcgttgagaatctccacatgatcttctccggaccttactcgcccaacccggcggagctgctggaggaggagctgtttggcgcgctgatccggcagatgcgtctggagtacgactatctgattatcgacacgccccccatgggaaacctgattgacggcgccatcgtggcacgccagtgcgacggggcggtgatggtggtggagagcggagcggtcagctaccgcctggagcagcgggtcaaaaaccagctggagaagagcggctgccggattttgggcgtggtgctcaacaaaattgatccggagtataacagctacggctattacacgcgctacggcaaatacgggaaatattcccgctacgagaaatacgccaaatacgataagagcgagattacggaagggtgaccggcatgaacgaccacggtcgaaaatggaaacggtttaaggtcgccgccgcggtgttgggcgtggtccttttggcgggggccgccggggtcacggttcacctgtaccgccagcgcaaagcccaggaggcggagatcgccgcccggcagcacagccttgaggagccggaacagtttttggcagaaaatgtaatcgaatacggcggcaaaaaataccggcgcaactcctatgtgaaagccatcctgtgcatcggggtggaccgctccgggctgggggagaagacgaccaccggcttcggcggacagtcggacgggctgtttctgctggcccaggataccgccagaaacacggtgaaaatcctgatgattccccgggataccatgacgcgcatcacgctgacggatctgagcggaaatgtgctgggcaaggatatacagcacctcacactggcttacgcctacggagatgggcgggaactcagctgtgagtacacggtggaggccgtttccgagcttttgggcgggctggccattgatcactatatggcggtggacaccgacagcatttccgtgctcaacgacggcgtgggaggggtcacggtgacaatcggagagccggggcttgcctcccgggatccggagcttaaactgggggagactgtaaccctaaaggggaagcaggcggaaacctttgtgcgctaccgggacattcaacaggacaacacggctctgtttcggatggaccggcaccagcagtatatggagggctttttcactgccctcaagaaaaaagcggcggaggacgacaagattctgatccgcctgctggacagcattcaggatcacatggtaacggatatgcagaaggaccagtacctgaaggcggctctggacgtgttaaacacccagcagctgggcgcaggcgatttctataccctgcccggcagcggtgtgaccaccgcccgctatgacgagttctatgtggatcaggaggctatgatccccgtaatcctggatttattttaccgggagatcgagtgatgaggcaataaccagcatttatgctgtttattggataaataatcatagtagaaaggagaggaaaagctatgaaaaagaaaagcgttgctgctttaatcctggcggcggctctggcttcccagccgatgtgtgtattcgcatccagcagttcatccagtgatgacggcggaagctcagcgaccacgaccacaaccacaagcagcaccaagtccgagagcaccgttacggtgtcctccaccggcgtcaagaccaccggagcgaccaccagtgccgcgcccaacggaagcaccatcggcgtggccgtggacactgtaaccaccaccggagtaccggtaacggtgaactccaggggagaggcggttgttggcgatatcgccatcggattcgcaaaggatccgggttctgccaccgcgggacttccggagaacgttgtagcggcgatcaacaatatcaacgccggaaaggccttaagcgaggtcgttcagggcgtggacgtgagcggctacaatgcgctgaccggcacccatgcaatcgtgaccaaggatgcggccaccggagcggtcaaggacacggcggcagaggtatctctgtatgtgccgaacctggtagagggactgaccaatgtggaagttctgttctacaacaacgttacgggacagtggactctgcttcccgcactgaaagtagatccggttaccaagaccgtggcggtgaacatccccggttccggtacactttctgtggtctacaagaagtaattacaagaatttgacatcggcgcagatgcgcagagggccagagggggccttgaggtctccctttggtttctcggtatgtgggagcgttttacgggagagaaaaagggtagtgaggaaaaatgtatagaaaagcggatcgtggctggctcaagcactgggacttcaccctgattgacgcaatctgtctgcaggcggcctacgtcgcagcttactggctgcgccatgggtttggatggccctatgtgaatcagctctactgcaatatggcctttgtcttcgtactgatccagatatttgtgacgttttttggcgagagctttaaaaacgtgttgaagcggggctattaccgcgaattttcgagcgcggtaaaacatgtgtgtctggtaattctcatcggggcattttatctgtttgccacgcagaagggggaaaactattcgcgcctgacgctggtgctgaccggcgtgatctatctggcgttcacctacgccgccagaatcgggtggaaacgctggctgaaggccagaggagtgggagcgagggggagacgatcccttttgattctgacctccaggactatggtggacaccgtggtacaaaacatactcgccaacaattacgagggcttccaggttgtaggggtggccctgattgacgatgacaaaaataatgaaaaaacttacaggggagtggcggtggtggccaacggtgaaaccgtggccgagtatgtctgccgggaatgggtggacgaaatccttgtcaaccttccggaggagataccgctgccccagaagctgctcaacgactttattgagatgggcgtgacggtccacttaaagctggtggaagtagccaagttaagcggaaaaaaacaccatgtggagcggatcggcacttacacggtgctcaccagcagtatcaatatggccagctggaagcaggcgtttttgaagcgggccatggacattgcgggaggcgtggtggggtgtctgatcaccgggcttctgtatcttgtggtggccccctgtatttacataaagtcccccggaccgatatttttttcacaggtgcgggtggggaaaaatggaaagaaatttaaattgtataaattccgcagcatgtatatggacgcggagaagcgcaagaaggagctgatggaacagaaccgcgtgaagggcgggatgatgttcaagattgacaacgatcccaggattattgggggagagaaggggattggggggattatacggaaatactcgattgatgagtttccgcagttttggaatgtgctgaaaggggatatgagcctggtggggaccaggccgccgacggtggatgagtgggagaagtatgatttacggcatagggtgaggctggcgaccaagccggggatcaccgggatgtggcaggtgagcgggaggagcgatattacggactttgaggaagtggtgaggttggatcgggagtatattgtggggtggagtttggggttggatgtgaagattttggtgaagacggtgggggtggttttgttgaggagaggggcgatgtgagggagatggttcggatgtgttattatcggtggaaaggtctggttggaatgaaacaagtgaggagaaatagataggatagattgggcctgcgctggggtgctttttggtggtctagtgtgggctttttgcgataattaacattaatgagtcgatagaaagaatgaacattttaagtgctgatttgagaagatttttgtactgcgttgatggatggagaggccctgagaaatagactaaaaggattacttggcagaaagattgctgtagaaatcatgaagatactatgaatactggaatgattgtccacagttttttcgatcgcagaaaatattcctgctctgtcggacgaaaagaggaagtacgttatggataagaagtatacgattgctgtagctggaacgggatacgtgggattgtcgattgctacactgctgtcatagtatcataaaatttatgctgtggatattgttccggcaaaggttgatatactgaaatagcgtaaattgcctattcaggatgaatatatcgaaaaatatctggcagagaaggacttatatttaactgcaacgcttgacgcagagatagcgtatagtgctacggattttgttgtaatcgcagtaccgacaaactatgactctagtacacagcattttgatacgagtgccgttgagaatgtcattgacctggttatgaagtataactcggaagcaatcatggtgattaagagtaccattccggttggctatacgaagagtatccgggagaaagcaggaagcaagaatatcctttttagtccggaattcttgcgagagtcaaaagctctgcttgacaatgtctaccctaaattttcagttgagttttcgtaggctatgatgacaggaaaaatcatccattattgccgaaaatgagcttttagggtacaggcctggggatagtgataagaacatttccaaatgaaatggtgaggagtttttcacaggctatggggtgcatttaagtgtatgaagctattttcaagcgaaatggatagggcaaaaaatatggattttttcgtttcgggtagaggtaaggaaatagtgataagtgcatttggaacgtaaaattggggttgaagaatttttgataggtgctgaaaaatgccgtaatatcacggattgtgatagatgatatagactttgcgaggggtctaccctaaagaatcatagttggaaatttaaaggatagaggcctggaaaacggttattagcagtttaagacctatggaagaaccggattgttgttttaaataaatgataaagacagcaagggggctaccctatgaactttagtgggtggtttttaagggggtggatgatgatttttaggcctgtgtgatagttcttgaagtcggaaatgaacatttcaggtgctggtttgtgttgatgggttttggatagacctatggtgatactgataagcccaactgaaatgaaaatgagcattttcggatagacctgtccttgaagtgataaacacattgaaactcaagataaagataacagattccgcgctgtgagaatcaacgtgtgatgacaacatcatcccagatgataaccacagccttcaacataaagaaatcagattggagttatgaagtatgagcaaggttgaattaaaaggcaaaacgatattggtcacaggtaccgctggttttattggcagcaacctggttaagcgcctgtacaacgatgtggaggacgtgaccgtcatcggcatcgataatatgaatgattattacgatggtcgactgaaggaggcacggcttgaggaactgtctgctcctccttcttttgtttttataaagggtagcatcgctgacaaagcaattatcacagagatttttgagaaatacaagccgcaggtggttgtgaatttggcggcacaggctggcgttcgatactccattattaatccagatgcgtatatcgaaagcaacctgattggtttctataacatcctagaagcctgccgccattcctctgacaatggggcaactggggtagagcatttggtgtacgcttcttcttctagtgtgtacggctccaataaaaaggtgccgtacagtacggacgataaggtggacagcccggttagtctttatgcggcgaccaagaagagcaatgagcttctggctcatgcgtattcaaagctctacaacattccgtccactggcctgcggttcttcactgtatatggtcctgctggacgcccggacatggcgtactttgggttcactaacaagctgcgggaaggcaagaccattcagattttcaactacggaaattgcaagagggatttcacctacgtggatgacatcgtcgagggcattgtccgtgtgatgcagaaagcgccggacaaggtgactggcgaggacgggctgccgctaccgccgtatgcggtctataacatcggcaacaaccagccggagaacctgctggactttgtgaccatcctgcaggaagaactgattcgtgcaaaggtgctgccggaagattatgacttcgaggctcacaatgagttggttccaatgcagccgggtgatgtgccggtgacctacgcagacacgagtgcactggagcgtgatttcggattcaaaccgagtacgagtctgcgtgagggcctgcggaagttcgctgagtggtacaaagagttttatatgtaagtattagcaataaaaaagatgcaacctgctatttagaaatatcccgcaatactgcggatcagtaaccgtccacctgtgcctggctctgtttcctgagccgagaaaggatcatccacttcatgaaatgtacggaaagtttaagaacagttctactataagtcacccgaagcagtggcgttttatccgtatcgcatcagtccgctgggtgctcacattgaccacaagtttggaaagatcaatggactggccatcgacaagggaatccacatggcgtaccgtccgaagcagaacggtatcatcgagctgcaatcgccgaacttcccgaagcgggcacagttccatgtgaactcggtgcctgagtacaaagagagggattgggcggaccatctgcgtggcgcaacgaagaggctgtggaaaaccagtatgttggcgtgaactgtggcaagtagtatcagtcctgtgaggtgctttccaagaagaaccatcttctatatctggatacaaaggatgacagctatgagctgattcctacggcggaaaccatgaagccctacaagattgcgattctgttctccggcttagagcggttgctggcgaattccaaatacaatcttcgtcaggatgagtgcaaagccgctgctgatgggctatgccggaatggattatggaacttttgcagagattcgtctgcgcagcgtaccggtggaggtatttgaaacctataaagaccggttgccggagctattgcggcgcaaagcagagtattattacagagaatacgccagagcagaagcaggcgcggagctgtggcgtaagggtgatctggaaggctatggtcagcttgttttcgagagaggcaagtcctccatttacaactatgagagcggctgcgatgagctcaagaaggtgtatgagatcatgaccgagacagatggtatctacggcggtcgtttctccggtgccggattcaaaggctgctacacggcactgattgatccggaatacgcagaggaaattgaagcaaaggtgacagccgaatacttgaaagcatatccagcgctggaaggtaagtattcgttccatctgtgtgagagcgcagacggtgctgcgctgtaaggagaagtaaacccatgaagtgtttgatattagcagctggatatgccacacggctttacccgctgaccgagaattatccaaagccacttctgcaagttggtgagaaaaccatccttgactggctggtggatgatctggtggccactacggatattgacgagttcgtggtgatctccaatcacaagttcgcccagcattttgaagactggaaagaaaacaaggtaaagacaaggcgtatgagatcacagtgattgacgatggtaccatcaccaatgaaacacgtctgggtgcggtcaaggacatacagctggcagttgaaacgctgaatctcaccgatgatctgctggtcatggcgggggacaatgtgctggattttagcctttccagcttcgtgtcctttatgcggaagaagaaaacctcctgtgtgatgtgccatgaagaaaacgagctgaagaagcagcaaaagacggtaatcatcacagtcgatagcgaggatttgattacctcatatgaggagaaaccgaaggggcccaaaggcaatctggctgtgccaccgttctactgctatcgcagtgctaatgtgaagcgcatccaggaagcactggatggtggctgtggatacgatgcgtgatatcaacagctatgagtatgtgaaaagtgtgttctcaaagtaaggcatagggcaaatcaatacgagataaacacacggataaatatgatggccgacaaacaagatcggctgcggaagaatgaggagtacagattatgagagatttcaaagacttgaagattgcggttgccggtactggctatgttggcctgtccattgccacactgctggcacagcaccataaggtgactgctgtggacatcatcccggagaaagttgaactgatcaacaacaaaaagtccccgattcaggatgagtacattgagaagtatctggcggagaaggagttggatctgaccgccacgttggacgcaaaggaagcatatacggatgctgactttgtagtcatcgctactcccacaaactatgacagcaagaagaacttcttcgacacaagcgcggttgaagctgtcatcaagctggttatcgagtataacccggatgccatcatggtcattaaaagtactatcccagttggttatacggcaagcgttcgtgagaaataccattgcgataacatcatattcagccctgaattcttgagagagtccaaggcactttatgataatttgtatcccagtcgcatcatcgtgggtacgaatgttgagaatgcaagactggtaaaagcagcgcacacctttgtagaactcctgcaggagggcgctatcaaggagaatatcgacacgctgtttatgggctttactgaggctgaggcggttaaactgttcgcgaatacatatctggcactgcgtgtttcctatttcaacgaactggacacctacgctgagatgaagggcctgaacacaaagcagatcattgacggagtgtgcctcgatccgcgcattggtactcattataacaatcccagctttggttacggtggatactgcctgccgaaagacaccaagcagttgctggccaactatcaggacgtgccggagaatttgattgaagctattgtggaaagcaatagaactcgtaaagacttcatcgctgatcgtgtcttggagattaccggcgcttatgaagcgaacgacagctgggatgagagcaaggaaaaggaagtagtggttggtgtgtatcgcttgaccatgaagtccaatagcgataatttccgtcagagctctatccagggcgtcatgaagcgtattaaggctaagggagctacagtgattgtatacgaaccaacgctgaaggatggcgagaaattctttggatcagttgttgtgaatgatctggagaaattcaaggaaatgtcgcaggccataatcgcgaacagatacgatagttgcctggatggtgtgaaagagaaagtgtacacgagagatatttttcagagagactgaggtgtaagatgaaacataatagaaaaccgcggctgtgttttgtctcatcctctggggggcactgggagcagcttcagaaactgaaaccgttagcggataaatatgaggggttttttgtgactgaaaagacccagtttgatgctcctttgggtaagtattgcatgattcagacggatctgaaagataaaatgatgccgttaaagatgatttggaatgctatttattcggtatttatctggatcaaagaacgcccagatttcgtgattacgacaggaacgatggttgcctatcctttttacttgatggcagtgcttttcaataagaaatttgtgttcatagaaacctttggacgggctaacatgccgacagttgcaggaaaaaagatggagaaacatactgatttatttatcgtgcagtgggaaactcagaagaagtattataagaaggccgtttacggcgggtgtctttattgatgtttgttacgtaggaggaagcctgttcagatgatatttgtaacagttgggtcaagaaattatccttttgaccgcttatttaaaaaactggatgagttgtatgaagagggtgtgttgactgattcgctgtttgcacaaacaggcacatctacatatcagccaaaacattatgagtacaaggactttatctctccagaggaattcttggaaaaagtaaatgaagccgatatcgtggtatctcacggggcatccggctcaataatgaaggcattaaacgcaggtaaaaaagtaattgccgttacaaggcttgaaaaatatggtgagcatatcaacgaccatcagatccaaaataatgaggcattcgcaagcaatggttatgttttgatggccgacatggaattgagtgatttaggagaatgctttcagaaaataattgaaggaactgatggcttgaggccgtgggtaaataaagaccctatggcaattgtaaatatgatagataagtttatacaggagaattggtgatatgagcagtaataaaatagcaaaatcagttagatatgcgcttcgatttttgccggatgaggtttatattcagttgaactactttgctcattttaagaaatttgcaaatttgaaaaatccgaagacgtacaatgaaaaacttaattggttaaaaatacatgatcataatcctctttataaagaattggtcgataaacatgctgtaaaagagtatgtagagaaaaaattaggtcgttgctataggggggggggggtatacggtgcctactcttggtgtttgggattcagtagataatatagattttaaacaattgccatcacagtttgtattaaagtgtacacacgattccgaaggtttggttatctgtaaagataaagcaaaattggatgtttcgcgggcaaaggagaaactcaggaaatgtcagaaacaaaatttttactatatcggaagagagtggccgtataagcatgtaaaaccgaggattattgcagaacagtatattgaagatcatgtcgatggtgaactacgagattacaaatttttctgttttaatggcgaaccaaaagcaatgtttgttgcttctgagcgcagtaaaggcacaacgaaatttgattattatgatttagagtttaatcatttggatataatgcagaaatatcctaatgcagaaacacctcgtaggagacctgtttgctttgatgagatgattgaattggccaagattctttctaaagatttcccacatgtgagagttgatttttatgaggttgatggaaaagtattctttggcgaattaacattttatcattttagtggatttatgccattcagaccagctaactgggataaaacatttggtgactggattgtgttgcctccgcagtaagaatatgctattgctgtgtaggaaagggaaaataagtatatgaacaaaataaaaatacttgcgataagtacttctggacttgcgcgcaaggaaggcatctcaacagtaatactggataatttttcacgttttgataaaaacatatttgaactgcatgttattgctgcgggtgcttataattatgaacttattcaagaattcgaaaaagcaggagtatccattaagtgcttgccatctcgaaaagccagcattgtattatatgtgaaagcttttattagtttgtttagacaagagaaatataatgcgctttatattcatggaagcagtgcaataatgagtattgaactgctgatagctaagatgtgtgggtgtaagatgcgagttgtccatagccataacaccacatgcgaccataagaaaagtgacaaattattaagacctttcttttataggttatacacagatgcgatagcctgcggtaaagaagcggggaaatggctttatggaggcagaccgtttcttcttttaaagaatggaagagatgttaataggtatcgatatgacggggaaacaaggagtgcgattagaaaagaccttggagtgagtggcgatgagctcttggttggtcatgttggtaacttcaataaacagaaaaaccagaaattcgcattggagatatttcgggaattattgaaaagaaacaataaggcaaagttgtatcttatgggggcaggtattctgttggataaaacgaaaaaccttgctgttgagatgggacttcaggataaagtgatttttactggctccattggcaatgtgcatgagatgctacaggcgatggatgtaatgactttaccatcattgcacgaaggattgccacttgtcacaatcgagtggcagattgctgcgcttcctagtgtcatttcagatgttgttacgagtgaatgtgcatacagtgatcttgtgacattcttgccgttagataatgcgactgcatgggctgagaaaatagttgaagtagcaaaactggacagagcggtaattgctgagaaacaagttgaattaacaaaagcggctggatttgacattaaccaaaatgcaagagaacttcagcgtttttttagagatagatgtaaacggtgaggataatgcctatgttagagggaatcagattaaagttgttaatgtatcctagaaggggaaaattatttacttctagaagaatcaagcaattaaagtataaagactttacaattattagtaataactgctggggcggtatgatttatgagtcgtatgggctttccaaacagagtccgactgttgggttgttttttatggcttcagattatatcagattcgtgtccgatttaaaagcatatacaactggtgaaataaagttcattaatccacaacactcgaaatggaaggacgccccacaagtatctggagatagcagatttggttcataccctgtagggattgtttctaatggtaaagaggaagtggaaatatttttcttacattatcattccgaagaggaagcgattgataagtggaagaggcgttgtgaacgagttaaatacgaaaagttgctagttaagttcaacgatcagaatggctgttctgaagaaaatctatgtgaattcttggctttaccatataagaataagattttctttacatgtaaagattggaatgttcaatcagaagtaattattaagattagacaactgtttaataaaaagtttattcaggcttcatatgagccgtttggaagaaacagaaaatttgacgttacagattgcttgaataaactggtttgaggggttatatgatgaaaaatataatgataatatccagagcgttaacatacggaggggcagagagagtagctgcaagtttagcgtcctatttaacagcatattataacgttgatttagtagttatagatggcgataagcagtcatatcataccactgctaataccatctatttaggacaatctgttattcataaaggaaaaggtatcaatcgaatcctttggtttgttaatctttataaaaaaattcttcgattaagaaaaagcaagaaatatgaatgcgtaattagttttttgacagaaccagagttgatgaatgctctgacaagccaatttggtaagtctattacatctattagaaatgtccgctcgtcagttgtttgtgggagaataaaaaagataagagataaatgggcgttttctaaaatggatggtattgtttcgctttcggaaaatgcgaaaaaagaccttgtcgaaaactatgatgtaaagcctgataagattcgtgtgatctacaatatttgtgataaagagtacatatggggcgagatctcaaaaggtattattgagaatgatatttctgaatggcttggttctggtaaagtttttgtgacaaccggcagattatccgagcagaaagcccagtggcacatgattagagcattcgcgggtgtagctaaaaagcatccagatgttaaattggcgattttaggaaaaggagaacaagaggagtatttgtcaaatctaatcggggaattagatatggctgaacagattcgggtgcttggtttcaagagtaacccatatatttatttgtcaaaagcttattgcttcctttttagttctgtatttgagggcctgggcaatagtattgttgaagcaatggcgtgcggattgcctataatttcgacagactgtaacgctggaccaagagaattgctttctccggactcttctttggagacaaaaattgatgaaattgaattggctgaatatggtatcctaacaccagtgtgtgacggcatacatcgtagcggtaatgctgctttgacgtcagcagaagaagaactaaagaaagcaatagagttgatggtagaaaacgaagcaatttacaagaattacaaacaaaaatctactgaacgcggagaacagttcgatatagagtcaatcgttaatcaatggatctctgtgattgaacagtaaatggagaattagtgtgaaagaaagtagaggacagccaaaaaaatggcgcacttatctacgctgtcagtaaggggcaactttttataggtgtttattttaagaatatagtttaagtatgctgaatgctttttatgcgcttaagggtaaatatgcgaataaaaagaaactggctgatcaagcaatctatttggaaagagtactatgtcaagaagctggaggctggcaggatcagatagcagtagcctttggcggctttaacagaaacttgtgaaaggcattaaatcgacgaagtcagatgaaaagctatacatgggatggatttatagatatgctgaaagtgtatccgcttgccaaaccaaagatatatgtaagtttattctaaaagcgaatgttactatgaggagccgtatgcgtgaatggcgcacgtacggatctgtgaggggcttgcggcgtgagctgcttgtctactcgactatcactgcctgtgtttgatgcatgaggaaagattttttggaggatgattcgggtatggataatttgatttgttatccgttaagaacggataaaagtgtttattttgaggttatcgttaatgcgatttctcaggataaaaaatatgaattagtttcattgaaagaagcccttcatgatagaagaaaattgaagagttcaaaaatagcatttttcagtttctacgaagacattaaatccagtagtaaatttaaggtgtatgcaaaatttattcagcacatattcgtgataaaatatcttaaagctcatggtgttaaaatcgttcatacagttcataatggtgtttcacatgatttgaactgtcgtgctattgaatcgaagctagcaaaatttttgctgacagaagctgatcgcgtaatcatgttatgtgatgagaccctttctgttgttaagaaaaattataatctggacatatctggcaaggcagtaaaaatcccccaccctaattatatagggatttacgggaatgaggtaaaagaggatataagagctaagttccacataagtccaaatgatatggttgtactttttttggggctggttagaccctacaagaatattgaactcattattcagcttgcacgcgattatatggggaaaggtgtaaagtttctgatagccggtgaagcttatgatcctgaatatatgaaaaaaataagaaagcttgcaagcggattagataacgttattattactggagagtttgtcgagaatgataatatggcaagttatcttagtgcggctgacgtgatgatacttccttatgagaataccagcttgaattcgggaccgatttttattggaccatcgttcaaaacaaatgtcatctgtccggatattggaagcgcaaaagagtttccagacggctatttgtatatgtattcatatgagaaaaacgttgaacattacaaaaaactcaaaggcgcgatggatacggcagtaaatgaatttttttatcacaaacaagtttttgatgggaagagtaatgcgctatatgagtttgtcattggttataattctgaggcaattttgaaagaaaaatacgccatgcttatagtgaaattggcgtagtaaatttgaaaggggttaatatgcagattaaagtcagtactattatacggtattatataacgttcctaatagtaatgaatgttagcctaacaaaagtcgcgtatcaatatttgggttggtttgcatctacataccacattattatactgtccggattttcagcggttgtactgtatctgtattgtataatgagtagaaatgtgcaaaagagactgcgaccgtacagtagatatttaaattgtatatgtacgcttacaacggtagtgatcataatagaaataattgcaacatggagtagatatgggatttcgataagaaatttttcgtacacattttatgtatatatgttcatttaccttgtatatccactcacttatttgttggttatcaaagatataaacttttcaaaaatgattaaagcgatagtagtatgtacggtgctatccttgcttctcagatgggctattgcaacggtatacaattttacaggaacggtattgattccatccattccgacggaatgcgcttctgctggatggactagaaatggtaatatgcgaatcaatccaccgtgctttattgcgttactggtaccgttatgtatgtattattactattgctccaatgaaataatcaatcgcatttactcgataataggaatagcaatagcaatcctatatacactgtatgtacatcaggcgcgaagctttttgatttatttatcagcgagcattctaattggctatctgatgaaaaaacgagaagtatcaagaaaacttgctgcaatcattgcgggaatttttattgtggcaattgtattaaatacgcaatacgctaattcattatttgctagtttttcgtcagaaagtgagctggcaagttcaacaacaacaagactggtatctttggagtactacttatcaatctttattaatcacccgctgactggtttaggcgcgctatggaaaggatttgacgggactctttcaatcattcaaggaccttttggatatgcttgtcttgaggatttaggtcttttaggcggtatttttagatttggctttttaggaggattgttgtatttttcaatcattattcgaatgattaacagaataaagttctcactaaaaatgcgtagtgttttgcaagaggactggtttatgttattgttctgttgcttttgttcctatctattgtttggaattaacattgactggttctatcagttgatagcattttctttgccttttgtaattgttatttttgaatatccggaaataaaacttaatgaggtgaaatgtaatgttcaatagagttaagcaatatgtgaataaagtattatatccaaacacttattcgaatgatcgattctgtgagtacattagggaacatggaggagtagtaggtagtaatgtcaattttgttaaccctaaagcgacacacgttgatataaaccgagcaaagtatatttccataggtgacaattgctgtttgtctgccgtttctttaattgctcatgattattcgtggtatgttttaggctatagtgatagtgagatatacccagatggggggggggggattagaatgggaaacaattgttttattggttataaaagtattgttttaagaaacgttacaatcggagaaaacgtaattattggggcaggctctgttgtgacgaaggatatcccttctaatactgtatggggagggagtccggccaaacaattgatgactttggacgagtataagactaagagaaagaagaatataataagagaaggcaaaatggcacgagatgtttttatagaatcaaatggaagagaaatgacaatagaggagtgtgctttctttggattttattttttgcagagaacagaagaaaactatgtgaagtatattgcgcgattgccgttcaattcagaaaggtccaattcagaacaagttagattttgtttttttaactcgaagcctttgtttgattcatatgagaattatattagtgctctgaaagaggatgctaatgagcaaaaaagataatgggataggaaagaaaattgttaacggaatacttgccgcaaatatatctctttgggcccgaattataaaaaatttttctgacaacccggctgcttatttgctaaaggagtcttgtaagcagttagaaaaaggaaacttttttctgtcatatcgactgagattgaagacagcccttccgaattatagtattttatattcagatcattgcagtaaaactgcgattattcttcaaggacctgtcaggcatgaagacgattttacattggaaactgtaaaattttataaatccacggttgaagacgcaattgttatcgtttctacgtgggatacggagtcaagtgtaacgattgaacaattgaaaaaagctggtgctgtggttgttacaaccaaggcgccaaactcgggtggtcatctgaatattaattatcagattattagtagtcgcgaaggtatacataaagcgtgtgagagcggagcggattatatttgtaaaacccgtacagatcaaaggattggaaaaacacacgtgtttgactttatgaagaatctgctttatcaatttccaaatacagatgagaatcagaatagaagaatgattacactttcaacaaattatggaaatatgttttatccctatttcttgagtgatttcttatatttcggaactgcttcagagatgctcaaaatgtttgactttggaacagattccagagataagtttactatgccaagcgggtctacaagaaggaactatgcagagaaatcttatgcaccggaagtttttcttgtaaaacagtatttaaataatttgggatatgtgtgtgaagatacagtggagtcgtattggaatgcgttaaaggaatactttatttgcctcgattttaaaacggtggatttgtattggccaaagtacgaaatgaaatacgcagagcatgctatttcaggcgcatatttcggtattgattctaaagaagaattaagaactgaaaattttgattttataaattggtttaatctgtattcgggttcgttgaaatataaaccagaatatgagaaatatgcagattatatcttgtaatgcttagaaatggagattaattatgaagtcactgaacagaattattattccagcggccaagatagttccggaggaacttcagagacttggtaagcttccagcaattatctatccaatcaatcagaggattgtgtttgattttttgtatgaacagtataaaggaaagtgctctggaatggatattatttgctacgaaaaagcagataaagtacagagaagattgaataaatatctggggactgaagtgtctgttaaggtattggatgagctaagtgatctgggttataccatttattatgggctaaatggagttgacgatcctgtcgtgattaactttgcggatacgattgtgcttgataacattttggatgaagcagatgatagtttctattgtcaagaagattacatgtctgatatctggacctattttgaggagcataatgggctgattactgaagtttatgacaagcgttccgtgaatacaaacataaggaagaatctatttgttggtgtgtttaagtttcaggatgcaggatatcttagatcatgtttggagagagcatttgctacagataatcttttgatgagcacattctatttcgctttgaaactgtatagcgaaaaatacccaatgaaaccagtaatgacaacgaactggtttgacatcggacatgaagataaatattacaattctaagattgaggttagagcgagggaatttaatcatattaccatagataagaatagaggtattcttagaaaatccagtgatgacaaggataaatttattggcgagataaaatggtatcttaagcttcctgctgatgtggaatatgtaagacctagaatcttcgactattcaacatcctatgaggcaccatacgtttctatggaatattatgcataccatacagtgcatgaattatttttatacggtgatctctctcatcagcaatgggtagatgttttcagtagaattaggtttctttgtgaggacttcaaacgctacaaagtaaatgatgataatattattccttctttagagagcatgtatatgacaaagacattacagcggtttgataaattgagaaaagattctagtttcgcagtttttttcaataattcgattgaagtaaacggacagatgtattgttcacttgatgcagtcgcagacattcttaaaaaagcaatacctgaacttctgtataacattaaggaattcaatatcattcacggagatctgtgtttttcaaatatgatggtagatagtaacctttctttcatcaaggtgattgatccacgtggaaagttcggtacatatgatatctatggagatccaagatatgagttggctaagttattccacagtgttgatggtaaatacgattttattattaaagatttgttcgacatcgactataatttggaaaaaacaagcattcggttcgtaattcaggatagaaaaagagactttgatctctataatgtgttccttgatgcattttcatctgaaattggggatgacattaaacagattgaacttattgaggcgttgcttttcttgagtatgataccgcttcatggagaaagtattactcatcaaatggctatgcttggaactggattggagatattgaatagggtggtaaacattcaggaggattgattatgtatagtgattattcgtttgtttttgatatagatggcacattatgtccgattaagaaaaaagaagagaaatatgaagatcttgttccgtatgggaacgtggtacagaaattgaaatactataaggaaaacggagcaaaaattattctttttacatcccgtaacatgaattcatacaatgggaatcttggcgtaatcaacaagaatacggcaagaatcctcatggcttggctggataaatgggaaattccttatgatgagattatgtatggaaagccgtggccaggacacaaaggattctatgtagatgatcgcacagtaagaccagatgagtttttaaaccatacggttgaagaacttgacgaaatctgcaagaagtcgaaagaacaatcaaaataagagggaagaatatgagtgagaagattacggttattattactatggccgggttaggaaccagattccgtaaagttggctataattgcccgaaatatatgatcgaagtgagaggaaagtcaatgtttgagtggtcgatggatagcttgattggttacaatgatcacgtatcaaaatatgtatttgtcgtaagagaagaggataaggctgcttgcttcattaaaacgcagtgcgcaaaatacggtatcaatgatgtagatatcgttgaattggatcatatgacagatggtcaggcaacaacttgcatgttagcgattccgtattgcaatccggatgatgcaatcatggtttataatattgatacctatgttgagccctacgaaatgaaatatgaggatatttctggtgatgggcatattccgtgttttcatgctgatggagatcactggagttttgcaaagctggatgaaaacggagctgtcgttgaagtaagagaaaagatacgtatttctgacaattgtacgcttggtgcttattatttctcatctgcaaaattgtataaggatttgtatggtgagtattatgctgatgacagtcgtatggaaaagaatgagaaatacattgcacctctctataactttatgattgagaagggaatgtctgtaacgattagtattgttaacgctgataaggtgcatgtacttggaacaccggaagagttgaaggtttttacagagggagattcaaaatgatcagaaaagtgcttagaggattaagacaccgtttcaatgatgagagacgcggcgtgaagctgattttctctgatttgcttcaaaattggcttgcagctggagtggcatgtcccaaaaagataagacctgcactttatagattggctggcaataaaattggaaaacaatgccatctatccccacggatgtttttagggcctggaccaggcaaattaatcgtgggggggggggggtatttataaactataattgttggtttgatttaggagatgatattatcatcggagaaaaatgcaatattgctatgaatgtgcatttcattaatgggacacatgagatctctggcgaggatagacgtgctggtaggggtattacaggaaaaataatagtaggatctggttcgtggattggagctgatacaattattatgccaggtgttacaataggaaaaggtgtcatagttggtactgggtcacttgttacatcaaatttgggagataatgcaatataccttggcagaccagctcgcctatataaaaagttataattatatagtttctctcgatttatataatgagagatagagaagaagattagaaaggcgtggagctttggctggattgaaaaataagtacatgacaatgtcggctcccatgaaggcagctttttggtttactgtatgtagtttcatgcagcgcggcattagcatgataacaactcctatttttacgagactgctttcaacagaagaatatggattatacagtacatatctttcttgggaaaacgttctccttatgatagtgacactttcactatttaaagcaataatgaatctgtatgtcaaacatgaggatcaagagcgagtattagctgctgtttgtggccttgaatttacattgtcacttgtatggctttttattggtatattattgcgcgagcaattcgcaaagttgcttggactatcttcaaatttggtatgctgtctttttgtatattttatgtttcaagcggtatttcagtgctggtcgctgtataaaaggtatgtctatgactataaaaaaataatttttgttacactgatgtacacagcaggttcagcgtttcttggtatagctgcagttaaatttataagtccaacagcagaatcgagagctttagcatcaacttttgttatttttgtcataggaattattttatatgcatctatttttcgcaaaacaaagacattttacgataaagaaatctggttatttgcactagggttttgtattccgctaatgccgcattacctttcagaatttgttttacaaagttctgataagattatgattaactacctttgcggctctagtgatgtcgctttatatagtgtggcttatgcggcgggatctttaataaatcttgtgactaatgcaattaattcgacatttgctccatatcaataccaaaaaataaaatctggagaatatcaactacttgctaaaagggctaatcaagtgttactttttgttggcgttatgctttctggtattatgatttttagccgagaaattgtttggatatttggcggaaataaatatattgaaagtgtagatgtcattgtccctatttgtttaggggtatatttcaattatgtatttcagctatttgcacgagtacaagaatattatgaacgaaagttaacggtaattattccgtccattgcgtgtgcgattttaaatcttgtacttaattatgtttttataaatctatgtggctatcaagcagcagcatatacgacatttacttgctatgctttattttgtttgattcatttcttgttttataggaaggtttgtagagaattgttgtatggagcagctttgtatgatgttaaaggaattttattgatttcgcttgctattatggtaagtggcattgcaattgttttcatcaatcatatattgtggctcaaatacacaataattctcatcggacttttagtattgcttatcaagcgtcagtgcattatcgatgcagtcaaagaaacaatgaaaaaataacagatataaaggaagcaaactataattatgaaaacagcaataatggccggaggcagaggtactcgtatctctgaattatatccggatataccaaaaccattaataccggtagacggcacaccagtacttgaaagagaaatctgcgcactgagaaatcagggctttaccgaactaatcctgacggtgtcgcatatgggtgataaaatcatgaattacttcggtgacggcagccgactgggtatatctattcagtattataatgaagaacagccgttgggtaatgctggtgcgcttttcaaattgaaggagcaacttacagaggattttctccttcttaatgccgatgcaatttttgaggtcgatttcaatcgtatggtggcttttcataaggcgcatggcggcttagtcactctgtttacacatcctaacagtcatctatatgacagcagccttctgattgcaaatgaaaataatgctgtggaacagtggcttgctaaagaagatgcaagacctacctattataaaaacagggtaaatgctggcctacatatgatttctcctgaagtattggagatggtaagcattgacccggaacaagtagggacgacagacgacgctacaggaaaaacagtcgaagtggatctggaccgtcagttgctgaaaccgttggttggaaccggtaagatgttctgctatgacatcccggagtatgtaaaagatatgggaacactggagcgctttcatcaggtagaggctgattttattacggggcgagtgcaggcaaaaaatctggctaacaagcaaaaggctgttttccttgatagagacggtgttgtcaataagtacgttggatttctccgcaatattgatgcttttaactactgccgggtgtggcagaagcaatcaaaagaattaatgaatctggatatctctgcattgttgtaaccaatcagccagtgattgcacgtggtgaagtcacagtagtggaattagatgaaatccataataagatggaagctctgttaggtcgagtatgtgaaagtttttctgtaactaaggttttataaggtcttctatggtaaaataaaaatcataggaggccttttattatggcaagagaaaagaaacccgtacacaaagtacaaatgacagatgggaaaaggaacattatccagcagctccttcaggagtatgacatccagtccgcagaggatattcaggatgctctcaaggatctgcttggcggcacaattaaagaaatgatggaagcagagatggatgagcacctgggctatgaaaaatcagaacgttcggacacggatgattaccgtaatggttataagcctaagcgcatcaatagcagctatggcagtatggacattcaagtcccccaggaccgtaaatccacgttcgagccgcaggtggtcaaaaaacgccaaaaagatatctccgatatcgaccagaagatcatttccatgtatgccaaaggcatgactacaaggcagatttctgatacgctggaggatatttatggttttgaggcatccgaagggttcatttcggatgtgaccgataaaatcatgccgcagattgaagactggcagaaccgcccgctttccgaggtatatccggtactctacatagacgccatccattactcagttcgtgataatggggtgatccgcaagcttgcggcttatgtgattcttggcatcaatccggatggacgcaaagaagtcctgaccatcgaggttggcgaaaacgaaagctctaaatactggctgtctgtactaaatggcttaaagaaccggggagtgaaagacatcttgattctctgcgcagatggacttagcggcatcaaagaggcaatcgccgcagcgtatccaaagacggaatatcaacgctgcatcgtgcatcaggtgcgtaacaccatgaaatatgtgtcggacaaagacaggaagcccttctgtgcggatcttaaaacaatctatcaggcgccaacggaagaaaaagccctggacgccctggagcgggtgacggaaaaatggagcgaaaaatatcccaattccatgaggagctggaaacaaaactgggatgccatttccccgattttcaaattttccacagcggtcagaagggtcatttatacgaccaacgccattgagagcctgaatgccacttatcgtaagctgaaccgtcagagaagcgtgtttccaagcgataccgcactgctaaaagccttgtacctgtctacgtttgaagctacaaagaaatggaccatgccaatcaggaattggggacaggtatatggtgaactgagcatcatgtatgagggccgtctgccggaataagccaatctgtcttatttttcacaggcggaatattcgcctgctcttgacatacaacgatagttgctgttatatataaaacaagggctgaaagtccaaaaaggaactttcagcccagtgattatcatagaagatcagcatttacagactttttttcacacactcgcgcctgctggaatttgtgaccgccgataaaaacccttgtactgtatcattcgtgtatgttcttacaggcaattggttcatttagtcatagccgcataaataatatgtaacaaccaagtcacctcaaaaaggaggcctataccaatgctatccatcatcctcaccgacataaaatctcccctaacctatcttcaaacagccttcttcctagccgccttcttaacccttctccatttgttttacacctatctccgcacccgggcattggagttcacttcccgcagtgttttcttgttcctcttcatatctaatgtctacatcaccctccaattcgccttcttctcccgcccaccaggctcccgcagcaccatcagcctgatccctggtgccacttgggggacgactctacagtctcatgcgtatgtaatcgaaaacatcctcatgaccatcccgctaggcatacttctcccctccctatggccgggaaagtcttccttgcggtcgctggcaaaatgcctgtccattaccctggcgtgcagcgtcgctttggagacggcgcagtttttgacgcagcgtggccactgccagactgatgacgtgctggcaaatgtggcgggggcaattatcggttggttgcttttttgtattggctcaaaaataatagctgctgttggtcgtccacgatctgatcgtaaggggtcttaacgcgggcggcacagcatagcaggaaaatcaggctcagtaaaaaaaataataaaaaaataatcatagcaggtcctttctgtaacggttgtaacggttctgccatattttcaggaatacaatatattatgttgaaaaagcggcaagttatgtcacaaatataattatttccatgaaagtgtggataaaacgttatgaattataccattactcccgagcttttaagtcaatataaccattatcttgcaaagtccggctattctaaggcgacataccagaaatacagaggggatctggcccaattctgtgaataccagaaggggaaaacgattgacgaaggattgtgtgaaatgtaccggcagtatttgttagatcattataccttacggggagcctgctccaagatcgtggcggtcaatactttttttaagtttgccggctgggatctccaaatggcgacgccccgcgtggaccggagccgtgttgtggatgccggaaaggaaatgacggttttagaatacaagcgattgctgagggctgccaaacggcatgataatttgcgcctgtattatctcatgcaggttttggcgcagactaagatcaatgtcagcgaacaccggtatgttacggtggaagcggtcagagatggatacattgcggttccgcggggaaaccatcggaagatcgtggtgattcctgaccagctgaggcaggagctggggggattcgctgaaagcgccaagattttggaaggccctatttttataagccgttcaggaaaatgctgggatcgtgtggcgattcacaagagtttaaaaaagttgtgcagagaagcgaaagtggatgaggagaaggtgagtccgagaagtctgtcccatgtggtggcctttggggcggctgtctatacgttggaggacaaatttaataaatagtggtagcgaagtaaatcaggcggcgcaaagcattttcggccgtttgcagaaatgctgatctgtcggtcgaaagacacagaaatttttatagcctcgtcggtcatatgatcatcgatctgtattcaaccatacaccgcctgcattggcagcttaacagcagccgtgcaggcgatttttcttccttaaacgatgatttcagaaaataattatggagaatcgtcgtcaaattcttgactttccccagcccctacgacaaataaaggcttccacatcgcaaaatatcaacacaactcacaaaccaacgcgtaaaacgcttgagcaacatctcaaagccgtctataatatctataattaagcaaaacgcaaccggactgaaaacactcgcgtttcaaaaatactgtattgccactccggctgcaacatttaccttctccacattttgtgatcaaagccaagggaggtcattggagtgaacgggaaacaactgcgctacatcacagccatcgcagagactggaagcatccggggcggagcagagcttctgggaaaagatgcgtccaccatggccaggacgctgaagaaaatggaacaggatttcaatgtccgcttattccggcggaccccggaggggttgaggacaactccggagggagaggcagtgctgggaattatggaggaaattgtcagaagctgcggagtgttgtccggtggtgaggcgctacctggcaacgaggtattgtccggcggtgaggcgctatctggcaaggaggtattgcccagcggtgaggcgctacctggcagcgaggcattgcccggtaccaaagcattacccgcctgcccagcaggatccaacctaaccgagcaggagatccgctaccttctgaccatccgtgactgtggctccatttcccgagcagcgtctgagctttacattgcccaaccgtccctgagccaggtcctccggcaggtagaggcggaattcggcctgacgatctttaaacgcaccagcaggggtgtagaggccacggcggaaggacaggcactgttagacaggctgtatgctattcgcggcctgtaccgccgtctggagctcacagtggaggaattccaggacatgaagcgcggaaccatcacctttggcgtaccgcagaatctgggcgcatatcttttgcccatggtgcttccggctttttccgcgcagtatcccggtatccgggttcgttttcgggaaaataattcgacggagctggaccggctgctgttggcggacaagaccgatttcagcatcatgcattttcaggaggaaaatgcagcgctggcctacgaggcgttttttgacgatccattttatctggtgattccgggtggaatgactggtcggtttggtttcccggaggggagaaaactgttggcggaggacttgcagccgctcaggaacgcgccctttatcatggtggccagaggccagaaattgcggcaggtggcggatcagattctggaaacatgtgggatcgcaccggatatccgctttgagacaaagagtatggagacggccaagcggctggccgcagcagggctgggggtgacctttctgcccggatcctatctgaccttgtattccggtatggagggattggcctgttttcagctggatgagagtttgggagcctcctggcagttggtggccgcttacccgaaaaagggcgggctgtcccgcagcgcccgggagtttttgcggatacttggggattgcctggcagatcacagcgcgtgaggaatacatctggcacgtcatctggcaatgagccgccaaagtgccccaatgcgccgccaatacgccaccaaagcgccccaatgagccgccaatgcgccaccaaagtgcctcaatgcgccgccaatgagccgccaatgagccgccaatgcgccccaatgcgccccccaatgcgtcccaatacgccccccaatatactatcaacacgccacaaaatacacgcccccaatcatctgcattttccctatatcccaacaggacaaaaatgtatttttcatataccaattcctgcgctatactaaagccatcaaaaaagtaaacacacaggaggggtaaaaaagtggaaagcattgaacttgcaaagcagaaatttggggaactgattgcagaagagtatcagcgaatcgagcggatgaaggcggacaacgaagtaaaggatttttccaaaatggaaaaaatcgtggtgggcatcctgcctggcgacggcatcggcccgatcatcatggagcaggccatccgggtcctgaaaaccttaatggaagaagaaatcgcctctggccatatcgtactgcgccccatcgaaggcatgaccattgagaaccgcgcagcaaggctccaaagcctgccggacgaggtatttgaagagatcaggcagtgcgacgtactgctcaaaggccctatggtaacgcccagagcgggcgatccctggcccaacctggtcagcgccaacagcctgctgcgtcgcggtctggagctgttcgccgccgtccgccccatccgtattccggagaagaacatcgactggacctttttccgtgaaaatatcgagggcgagtacatctggggcaacaagggcatccaagtgaacgaggatctggccgtggacttcaaggttcagaccaaacagggcagcgagcgcatcgctcgtgcagcctttgaattcgccagaaagaacggcaagaagaacgtgaccatcgtaacaaaagccaacatcgtaaagctggcggacggcaacttcatcaaggctgtgcgcaaagtcggtgaagagtacccggagatcgaaatccaggagcgcctggtggacgccatgtgcgcaaaaatgctggacccggagttcaacaagggcatcgaggtgatcgtgctgcccaatctctacggcgacatcgtgaccgacgtggcggcggagcaccaggggggccttggtaccgcgtcatcctccaacctgggcaacaaatacgctatgtttgaggcgatccacggcaccgctccctacctgatcagccacggcagaggggagtacgcggatccctgcagcctgatccgggcggtgggaatgttgttggctcacatcggttacggcgaccgcaagaaaaaactggacgaagcgctggatatctgtaccattacggagcgcagggtggtgttgaccaccatgcccgaggatgccagcacaaaagaatttacggactatgtaattgaaaccttggagaaaatgtaaatacatcagatgaaaaatgagatcgaaattctgcgaaacggtgtggaaaatacggcagattcggtcaaacgttttttagcgctggcaaagccggcctgaaaatgtcctgtgccctgcgtgatgaacgcgccgggtatgggactttttttcttccaaccaggcccaagttgtaaaatgcccctacccacccccaaaaaacactgatttgcgagatagagtaaatattaaatattgctgccgataaaataggcggcgaatgaaccaagaatcgatcaagattggcacgccaagcttgacggataagaaattcagtgatacaattaattgaaccaatagtttaattaattgtatggattaaatttagcagaaaggagcaccacccatggcccgaagaaaaaaagaaccccccgacacccaccgcgcccgcatttccgacgccgcacagcgccttttctcccagcgcggcgtcacctccgtcaccgtggacgacatcgccagggaggcgggatacagcaaagccaccctgtatgtgtatttccaggacaaggaggagatcgtccggttgctggtcctgcgcagcatggagctgcttcatgactcgatccgtcaggcgctggccggagaggacggcgtgcagaggcagtaccggggcatttgtctggcgctggagaactttcaggagcagtatccctattattttgagtccgcgctgggccggataccgttggatttcgccggtgaaccccagaacatgccgccggtggagcaggagatattcgaggtgggcgaggcgatcaaccgcgatatcgccggcctgctggaggagggaatccgagccggcaggttccggcacgaccttcaggtgttgcccacggtgttcgcgttctgggccggattgtccggcctgattcggatggcgtcggataaggcggaatacattgagcttgtgatgaagcggtccaggcgtgaatttctggattatagctacgacctgctataccggtccatcgcggcggagccggtccgggaagcggagtccggcgattaattagtcccggctgtaatcagcgccctgtcgccaaaactttaattcccccaaaacgtgaaatcgaaaggaatccgccatgaacaatcattactccgccctaccgacatctccctccccgtccaaaaccctcctggctatcctcggcagcccccacgaaagcggttctaccgccgccatgctccgctgcgccacatccgctgcaaaacgcgcaggctggcaggtacagaccatcaacctgtatgagaaaaacatcgcattctgccgcggctgccgcgtttgcattgagaccggccgctgcccgcaccaggacgacagccaggagatcgcagcgcttttaaagtcctgcgacgccgtagttctggccgctcccgcctactgggccaatgtcccggccgcggtaaaaaacatgtttgaccgccttttgggaaccgccatgggagagaggaacgcaaggccccagccgcgcttgtcccggagtcagcgttaccttctcctgaccgcctgcaacaccccggcgcccttctcctggctgttcggccagagccgcgggccgctgcgcgccatggatgaattcttccattacgctgggatgagccggatggggcgggtggccttcagcggcgcggcgggaaaaacgacgctcccagaccggatcagccgcaaaatcgaatcctattggaaataagtcttaatcaggatcaatgaatctcaatggattcaagctgctcaaaacaaataaaacaggccggccatgcgaatgatcctctcgcagggccggcccgatctcacctcagccgcacccgctcccaataccccgcgttctgccgcctcggtccatatatccaatcgtatatcccgtttcacaatactaaaattctaaaatcccatcctcccccaatcactccacaaactcatactccttaatttccctcaccacatccagaatcgtcccgtcccggctttcaataatccccacaacccggtccttaaactgaatctcatccggcgttcccacaatggaataagcgatatcccgcagctcctcaatggtacaaatcggaagcccgcacccctcatacgcctcgatcagatccgtccgcctgggattaattgcgatgccgtaatccgtcaccacgatatcgaccgcctccccgggcgtcaccaccgtcaccaccttgtcgcagacagtgggaatgcgcccgcggaccagcggggccacaataatggaacagttcgacccggccgccgtgtcgggatgccctcccggagccccgcgcacgattccgtcggagccggtcaccacgttgacgttgtagtccacgtccacctccagcgcccccagaatcacaaagtccagcttattgacaaaggcccccttgttcatgggattggcgtactcggaagtagaaatctcaaaatgcctcggattgttcttaatagactcaatcgcccccagatcaaaggcctgcgcatccacaatattgcgcaccagccccgcgtccagaagatcgcacatgggcttggtgataccgccgatggcaaagctcatatggatatctttctcctccataatcggccgcagcatggtgttgaccgccagcgaagccccgcccgcgccggtctggaaggagaagccgtccttaaaaaatggggacagctcaatgagcctggtacaatactccgccatcttcagctcccgtacatccttggtcatgcgcaccgcattgctgacgatcttggccgggttgccgatctcatccaccacgcacacgtagtccacgtccaccatggagatgctgggcgggaagttggggaagggcaccagacagtcggtgatcaccaccacgtggtccgcgtaccgggcgtccaccatagagtaggagagcacgccgcagtcactctttccgccaacgcccctggcatttccgaaggcgtcggaggtgggagcgccgataaatgcgatgtcgatgtgcacgtcgccctcctcgatggcccgcacccgcccgccgtgggagcggatgatggccggggttttcagcttgccgtaggagatggcctcgccgatcttgccccggacgccggaggactggatgcccgtgaccacgccctcttcgatgagcgccgccaccggatcatgggccgccccaagggagctggcgcagatggtgatatccttcacgcccatggcgtttacctgctccattaccatattgacaatataatccccgtcccggaaatggtggtggaaggagagcaccatgccgtccttcagcccgcatttctccaatgcttcccggatggagccgacttgtttctcctgttttgggtccaccacggcgcgcacggtgggagccgctttgcggtactcctcgtcgtcccttgcataggacccctcaaatccctttttcccgtaccgggccagcagctcgtcgggaatctcacgtccaacctgattgatcattttacaaatccccctcatatacaccggatgcttttgccagccgcagcgttctcatggcgccgtcgtagaaagcgatgtcgatcatcttgccgtccacggtgaaaacgccgatgccctgggcctttttctcgtcgatctcccgaaccaccttctcagcgaagatgatctccttgcgggtgggagtaaagattttgtggacgatctcgatctgcctgggattgaccaggctcttgccgtcaaagcccatcatcttgatcatccgcacctcccgctcaaatccctccatgtcgtccagattggtgaacacggtgtcaaagcactggactccggccgccctggccgcgatgatcatgttttgtctggccccggccagctccacgccggtgccggagatcacggtctgcaaatctttggtatagtccccgccgcttaaggcgattccgaagagccgctccgaggactcgcagatttccagggcgtttaacacgccgcgggtggactcgatagccgccatcagcagcgttctgccaaccggcgcgccgaattcctcctcggccgcggtcacggcttcttccaccacgcgcacatcctgggcgcgctcggttttggcgatgcggatggtgtcggccccaccggccacgcagacccggatgtcctcacgccagtggggcgtgtccaggccgttgatgcgcaccacgcgctccacgccgcggtagtcgatctccctcagagcgtgaaacagggagtagcgggccgcatccttctggttctccgccacggcgtcctccagatccagcataatggagtccgcgccatagatgtacgggtccttgatcagccccggtttctggcagtttaaaaacatcatggagcgtctcagacgctttttgtcaggatgaatcattgaatcgcacctccccatggaagatgttccgtctgtccggcggaacggtacacggcgcattccacccgcgccttcagggtgcagtctaaggcgcccttgtccaccacggtgatcctggcgtccgtcacgtccagacgggttaaggtgtccagtacggtccggcggatctgccgcccgaactggtggattacgttgctctcaatggagagctccagggcgcccgttcccggctccaccgtgacctgcgcgtcgctggattccagggtgccggccattgcggctttttgaatcagcatagttcccctccttatttgcatgttttgattgctgttaaattcagggtatcatatttttcatcccttttccaatacgattgtgcgtatagaagtataggcaaatgcctatggcgtgcgttccccaccgccccgaaaagcccgctgctccgccagcagtgtttccttcagaagctctgcaaaccgcgccacggcgccggagcggtatttggcggagggaaagcccagggccagggggcggaagcatccctcctccccgatggagtagtagtccagccggtaggagggatcggcaaatgtctccggcaggaaggtgatccccagtccggcggaggccaggcgggcgatcagcgtcaggttgcggtaggtccgctggttcgcaggcttgaagccatagcgggagaacagctctacggcaaagtcgtggaggcggttgttgatatcgtacagcagaaacgggcactccgccagcccggccgggtccacccaggggatacgccccggctcgcggtggacgtttgccggcagctccatgcccttcggcacggcgagcagaatctcctcatccataaatacctcgcagcagatgccggagtccgacaggggaggcaccaggatgcccaggtcgatggtccccttttgcagtttttcctccagatccttggtccggccctccacgatctccactgtcacctggggatatttccggtaaaattccggtagaacctggggcatgaggaagggggctctctgggctgagacggcgaagatcacggagccggaaacagccccggcctgatccgccagacggtttctcatgtcccgctccagccgcagaatttcccgggccgtgtccaaaaagacggccccttcccgggtcagcttcaacccctgcttggtgcggataaaaatgggatatcccaggtcgtcctcgtatttttttagaaactggctcagggtgggctgtgagatgtacagccgtttggcagccgccgagatgctcttaagctcctcgatggcaaagagatagcggatatttttaatgtccaatgtgcgaaccctccttcagctttgcgtccagagcccggtgctgctcctggagcatgtcgatcaccatattggaaaatgcacgggtcgccttggagagatatcccaccggcgggtaccccagcaccagggtgcggaactgcccggtctccccgatggagaaataggagaggctgtggcggttgtcaatgtaggtttccgggataaaggtcagccccatgcccacctcggtcaggcggattaaggtctcaaagctgtcgtgggtctggatgatcttgggcgcgatgtggtactccgtgaagatccggtcggaaaaggtgctgagacggtgattgatgctgtacagcaaaaagtcctggccgttcatggtggggtaatcgatccacatgcgcccggttgtgggattgcggcgggcctgggccgtgatgggatgaccgtcgggcgcggccagaaagatttcctcctcgatgaccttcagatagggaatctcctggttttccaggggaaggcttaaaaatgccacgtccgcccgtccctcggccagcaggcgctcctgccgggccatgtgggcctcggtgatggcgacctcgacattggggtatttccggcggaaggcgggcagcaccagcgggagcaggtagggcgaccggaaggaggagagggagaagcacacctttccccgctgtagcccggacagttccatcaactggttgttcagattgttctgcatgcgcatgatctggcgggcggtgtggatatagagcgcgccctcgcaggtgggctttaacccctgaggggtacggataaacagcgtgtacccggactgggcctcatagttttttaggaactggctgagggatgactgcgccacgtagaggtgctgggccgctttggagaggctgccgcactccgcgatggccagaatgtactgtacttcttttaattccatattcacggttcacgtccttttcaacttgtgcatcttatccatcggaaaatccgaaaggagggtatggagtattgatattatccaaaaaattgattttatattataataaatccacgatgaagtcaacatttaaaacggcttcaggggacgaggcggccgccggtccggttgagaaataagaacgaggagatagaagatggcgagcaatttaaagatgacgagagagctggaccccaagcggccggcagtgctttttatacccggggggatggccacgccgcctgcggtattcgacggaattgagggggagattccctggcagtctgcggtgattgactggagcagatcgccgggcccctgggatattgtggagttgggaaaccgggtggaggagctggagcgggaactggggctggagcgggtgattctggccgcttactcggccggaggcgtgatggcgcttcaggcggccatagcggatgaggaacaccgcatcgccggcctgttgctttccaacacaggcccctgcgccatcggccacggggacctggatctgccaaagcggattcaggagcagtggttttccatggaactgttcgagccgttcatttcccgctgtttcgcccgcccggtcgatccggcgttaaaggagacaatgattgggtacgcaaagcaggtggataaggagacggtgtaccagtcctccaaaaccctgcgggagcacgacctcaggccggacctgggaaagatcgcctgcccggtggtcatcgcccacggcagcctggacaaggcgcgcaccctggaacacgtgaaaatgctcaccgacggcatcgcggacaccgaggtgttcctgttaaacggaggccacaccatcatggtggaggaccgcgacaactgggtggaaaaactgaattacctgatccaaaaagtgacaaaacagtgagagaaaaggggaaaataaaatgcttgcactggtagggtttctgattatcattgtaatgatgcttctgatctttaagagcaaggcgcttcctgcgttctgcttcgcggtgctgcccatcatcggggcgctcatctgcggcttcagcctggcggatatttccgatttcatcggaaagggcgtgggttccacctggcagacggccattctgttcatcttttccgtgacctatttcggaatcatgaacgacgcggggctgtttgacaagctggtggacggcctggtgaaaaaggctggaaaaaatattaccctgatcctgatttttacctccgtcatcgccatgatcgcccatatcgacggcgcggcggcggccacctacctgatcaccataccgaccatgctgcccatctacaagaagatgcacatccggccaacggttctgctgctgctctgcggcgcggccaccggtatcatgaacctggtgccctggggcgggccgaccatgcgcgtggccaccacggccaatgtggacgccacggagctttggattaaaatgattcccatgcagatattcggcctggtatccctgatcggcatctccgtttatctgggcgttgtggagaccagacgcttggcaaagctggggatcgtggcggcggagaccgatgagacggacgaggagaagagcgtggatctttccttaaagcgccccaagctgctgtggttcaacctgattttcaccattgtgctgatcatcgccctggtgcagaaatggcttcccacctacgcggtgttcatggtgggcaccatcattgtgctggcggtcaactatccggatccccagcttcagcagaagcggatccaggcccacgcgccttccagcatcatgctgaccgtcaccctgctctgcgcgggtattttcctgggcgtgatgacccagaccggaatggttctggaaatgtccaaggtgctcataagcgcccttcccgttggcctgcagcgctatctgcattacattgtgggcgctctgggcgctcctctgggaatggttttggggccggatccctactactacggcatcatgccgattatcggccagatcgtggagcccttcggcgtcaccctggacaccgtggggcgcgctatgctgatcggcgagaacgtgggcctttccgtgagtccggtggtgccgcccaccttcctggccatcggtttagccggggtggatctgaaggaacacatcaagttttccttcctgccgctgtgggcgctgagcgtggtgatgatgctttttgcaattattgtgggaattatttaaaaaattagaaaaaaatgcttgactaatttttacagtatgatataataaattccgcagccggcactgagggctgcggaattaaaactgaaaattgggctatcgccaaatggtaaggcaacggactctgactccgtcattttcttggttcgaatccaagtagcccagctcagaagcctcatggagtttccatgaggtttttttgaatgcaatgggtcgccggcgcggcctgtggcccgcgctcagtcgatataattttggcagtcgaacaccagggagagggccggctggccgtcctccatgccgatgtaaatgtggtccgccaggttcagcgccattttcatgcacttgcagctgcccgtgatgtccaacccctcggagttgcggatgacggcgttgacgatggggcggtcctggtctgcaatcaccaggacggaggcggtcatctcggcgaaatcccgcagcgcaggcagaatcgcggcgtcgaaccaggcccggctgctgtccagccgcgcgtgggcgctggtctgacggatagcccggatggcttcagccgcggcctgcagctctctggcggacatggcgtctatctgggagctgatgtcgcagccggccccgccttctgtgtaatcataggtttccatagtaagttaatacctcctgttgcgatttgctacataatgttatatatgtacagcctgtattataatacatcttattttggtacatgtctacccatataattagtgtactgaaaaagagggggtgcagcgtgggacggattgagataaagctggagtcgtacctgaaggagcataactgcagcaagaacagtgtctgcaaggcatgcctgatgcagcggacgcagctcaacaattactgtaagaataagatcagcagggtggacctcaccattatggccaggctctgtgagtttttaaaatgtgatatttcggatcttctggagttcaaggagggcgaagaaaaaggagaggactaagcttcctctcctttttcttccggcacgattctgacaacattttccacggaacaattcaatatggtacacagcttttccagggtcagtaccgtaacatttttattgtgctgcagatttgaaagcgtttttttgtcaattccttccttgatcagccgataggttgtgatgcccatttccctcatcgtttgccacagcggactataatcatacatggtatttcacctcatcactaactataagtggcaaatttcatcttgaatatactgaatatagtcggtataatgaagcaaaattatggaggaaatggaaatggaacagtacgattatcgaaaaacggaaaaactggaggaaacggtatacgcggagattgaggcactatctcccgggcagcgcatgcaggtctgggagtcgattcaggatgtgaagcgcgcggccgaagcggagcggctggccaggggccggcagtggtttgagcaggcggttctgcccgcgctgcgcggctttgccagggccagctcttcgcttctggaggtggagtgggacagcgacgggagtatcaccgccgcattacgctgtgcggacgatctgcggattgccgagagctgccgcagcctgcgcgtggccctgtttatggcggaggatatcctgatcagccgggacggggacgagctggtgctggcgctgatctacgacagcggatccgttctggcttccctataaggcacggcagaccatgtgccgcgcccggtagccgtccagggagattccaccctggcagggcgtgacatacatcacaaagtccgggccgaaaccgaagattccccgctggtccgcagtaaagtacagaggcgttgtcccgtagcgtgggtgggagatcacaagaccttcgccctcccggcagatcgttagcatgcagagggtttcgtcctgataataatcccccggacgcagcgggcagtccactggcgcggactgctgcgcccggcgcagggcggcggtccgggtgggaagcaggtgctccaacgtatcgccgtggaacactaggtattcgtccagggatccaacccggtaggagccgttttcctgtgggatcagcggcgcggggccgtactcgcgcttcatgtaaaacgctccgtcctgctctgtgatctccatcacaaccggatcgtccggaagcgcggtcacgaagatgccggggcaggccgcgcaggcgttctgcacgtctgcggcgttggaatcaggctccagccccagcgccagcgcggccagcttcttggccgccacggaggccatgtaggtggtggtgttgctgagcagaaccacctccagctccttctcgggaatccacagaagctgggcgcggtaagcggcgtccgcgcctccgtgctcgtagaccttgaggccgttccagacatgggtcatcatgccgccgcagtattcgatctcactgccgtccttgagcacagccgcggtgagaacggtttttaccgtctcggggctgaacagggagggattgcggtactcgtccagtattttgatcagatcccgggcgcaggtgttgacgctggtgggtccgtaaagggagtagttaagcgggttgtagtagtaggtcccggtgccgtcgtcctggtaggagtaggccagtcccgggatgatctggctgtagctgccccgcaccagggtgttgtccatgtgcaggggcttaaagatgcgctccctcacaaactggggaaagctcatgccgcttaaacgctccacgatcacggacaagaggtgaaagcccgtgttgctgtagagatagccctcctggggcgggaagttcagcgatttctgcaggcggatggtctcgtttacgtcctccatgtcgatggagtcgttgatcttgatcccccgcatgaacagcagctcccactggtcccggatgccgctgacgttgttgaacatctggcgcagggtcaccggctcatcaaagcggatcaggtcgcccacatagcggcggatgtcgtcgtccacactcagcaggccgtcctcctgcagcagcagaacggagagcacggtaaactgcttggagatggacgcgatgtgaaagatgctctccggcgtgatgggaatccggttttccaggttcccgtagccaaagcagccctcgtagaaggtttccccgcctttgcggatcaacacctgtccgcccgggcaaagcccctctgtccatctcgataatatctgtctcacattttcttcaaggttctgattcatgatttcctcctgatggttccggtaatgtgtatcatttcgcctctaatcttctaaacagctccagccagttttcaccggcgatctttttcaggcgcgtttccccgtagccgtggtccgccagccggccgataaactccggtaacgccccgtggccgcccaccagatcaaaggacacatagggcatacgggccagatcctgggccgagcttccggtcaggaactgatcgcagaagtcgaaaccgaagcccacgtggtcctcgcccatcacatcgatcatgtgatccaggtgttcgatgagcttttcctggctggcgccctcctttgtctccgaggcgatgatgctgcagccgtttaaaccggccagtccgcccctttttgccagttccgccatctgggcgtcggtcagattgcggttgttggaggcgatggtgcgggcgttgctgtgggtggcgacgatggggcaggaagtatggttcagcacgtcctcaacgccctcgtcgctcaagtggctgatgtcgatgagcatggagagcttctccgcctcccggaccaggtccaggccgaactgggtcaacccgccttttttcagtccgcccatgaaatcgcagccgtccgcagcctggtttctgcggctccaggccagtccaaggccccgcacccccgcggcgtaaaagctgtggagcagcgtcagggaggagacgggctccgccccctcaaaggacatgagcacgcccagttttttgctgcgggccgcctcctcgaaatccgccgcgcaggtgcacagcatgagaatgtccggggactctgcgatctcgcagtgcagcgcgcccacctgctccatggcgtcctccaaggcgccgtagggcaggcggcagctgtccacaaagattgaggcgaccacgcccgtcacatgcccggccgcgaaggcggggtagaagcagcggcgtatcacctcccgctccccgttccgtctgcgctggcagacatccccgagcatgtcgaaatgcccgtcaatggtgtattgaatattcataagtcctcctaatagatcaggtctgagaagaatacgatgcactgggcatccttcaggccggtgttcagatagttgtgaagcgtattctggggaatgtagagacagtccccggtgccggcgtcgtacacatgggttccgatgtgaacttccagctgtccctctgtgatcagcacggtttcgtccatgttctggtgcaggatcatagtctccgtgacccagcagccgggctttaaggtgacgaaaagcccggtcatgcagggtttgtggttatccggcagccggtccggcgtgaagatcgagtaggccgtgtcgatctccggtattttcatgggaacccgctggtccctgcggagtatgtaaccgggaccgtagggcgtgtcctgatccggcgagtgggacacggcggtctcattttcctggcccataatcaggtagacctcggaacagccgaggcaggccgcgattttccgcagagcggccagggacggttccttttgattgcgttccagctgggaaatatatccgatgctgtaaccggtctcccgggccacctgggccagcgtgtatccctttttcttccgttcttcacgaatgcggttccaattcatagtcatttcccccgtttgtcagcgcgcctttaccgcccgttcaatccgcgacagtccttcgtccagaagcgctctgggacagccgatgttgaggcgcataaaggtgtcggcctgctcgccgaagcggtagcccatgttcatgcgcaccttggccttttccaggaaaaactggttcagctcctcgtttttcagtccaagtcccgcgcagtccagccacagcagataggtgccctctggcacgcagaccttgatttcggggatgtttttgcggatatagtccaccgcgtagtcccggttggcctccaggtagaccaaaagctggtccagccagccctcggcctcgttgtaggccgcggtcagggcggtcatgccgaacacgttgcttccaaggtccatgcagccgtcgtagatggccatgtaggcgtcccgcatccggggattggggatcaccacgtaggactggcagagccccgccaggttgaaggtcttgctgggcgcgtaggcggtcacggtgcggttcgccatgtcctcggacagggaggcgatggaaatgtgctcgtggccggagtaaatgaagtccgcgtggatctcgtcggagactacgatcaggtcgtggcgtttggcgatgtccgccagagcggtcaactcctcacgggtccatacgcggccggcggggttgtggggattgcacatcatgatcatcttggtgcgcttatcgatctgggcttccaggcggtcaaaatcgatggtgtagtagccgttctcatccttggacagctggtggtttacgattacccggccgttctcccgcacggagttgtagaaggggcggtacaccggcgtcatgatgatcacccggtcgccgggattggtgaaggccagcacgctcatggacagggcgggcaccacgccggggctgaattccacccactctttctcaatgttccagtggtagcggcgtcccacccaggaggtgatggcggagagcaggccgtcgccgtggaaggtgtagccgtacacggggtggcgcaggcggcgctccatggcggcctgaatctcgggggccaccgcgaagtccatgtctgccacccacatgggatggatgtccgggctgccgttgtcgtcccatttcaggcagtcggtgccggtgcggtcaatgatttcatcaaaattatactggttcataatggattcttcctttcgtattgtatacagtatgcatatatgcggaccataactgggaggcgccgggcagcgcagtgccgggcggccgcccttatgcgattccggccaggccggtgatggcggagatggcgcattccacctcggtcatatcctgacagatcacgtcgacctctgtgccgttcacccgctccaccatgggcagctgggccaccatctcggccatggcggtggttttaaagtcgatggccaggcggataggcgcttccacgcggtagaggggcagggcctttaagtcggattccagtacccgctttacggccgcgaccgtgtcctcccgcagctttttctgcggcgggaacttggcggcgtagcgggacaggctctccttggtggtcacaaactccacccagggcatctgcttctggtcgatgagctggcggcgcagaccggaatccccggccaccagggccaccggcaccccgtagtccccggccagggccgcgttggtggtggattcgttcatataatggccgttgatcttaaggcagcccacggcgcggccggaaaagctgtgatccatgttggccaggggctcgccggggcctgcgtggtagccggccagaaagaccacgtcgtaactttcgtccagacaggacatcatgaagtgcttgcgcggggaaccgctgaccaggctgatccgctcgtccatggcgcagagctcatcataggaaaggttggtgccgctgccgtgggaatcggagatggtgatctcctccacggagccgtttacggccgactggcgtatgccgtctatgatccaacggatctggttgtgaagcgctcttcgaaatgaaggaacctcctccttctcctggaagggggcggtgattccggccatgccttccatgtccaccgaaatataaattttcatatgcttcctcctgcaaaattggggtcgaaatgacctgaaatataaaaatattataatcgtacaagaaaataaagtcaatatattgacaaaataaacaaaaataattatactataggtaaaaatgagcacagaggaggatatgctatgaaaaaaagaatgttagtttcactgctgcttgccactgcggccgcggcgacgcttagcgcctgcggttccggttccaagccggccgagacccaggccaccacgaatcagggggggggggacataacttccgccgctgaggaggagaccgaagctgaggcagaggaggaggcttccgccggctccgaccgctatctggtctggcgcctgaacaaggagcccaagctctgggaccccactaacaattctgaatccatttcggatgcaatcgtgaaacagctgtttgagggactgaccgtctccacgtccgacggctttaagccggggatcgcagagtcctgggatgtttccgaggacggcaagacctacaccttccatttgagagacgacgccaagtggtccgatggagatcccgttaccgccaaggattttgagtattcctggagaagaatctgcgatccggattacgcttccgaggcgctgcaggccatcaccgactatgtggtgggcggccaggagtatttcgacggaaccggctcctatgacgacatcaaggccacggccattgacgactacaccttcgaggttgtgttaaagaacgtgaccccctacttcccgcagctggttgccaacgacgtttaccttccgatcaagaaggacgttgtggaggcggccggagagggctgggagaagaagccggaaacctgcgtcagcaacggaccgttcatgctggaagagtatcaggtaggttcccatttcctgttcaagaaaaaccccaactactatgacgcggattccgtgaagctggcgggaatcaaggccgtgatcatcaccgacgacaacaccgcttaccaggcataccaggcgggcgagatcgacgtgatggacaaccttccctccgagcagattccccagatcgtggcggaagatcccaacgtaatcgtcagcgccgacaccggagctcagttcatgaacttcaacgtggacaaagcgcccaccgacaatgtgcatgtgcgcaaggccatcgcgtacgccattgaccgcaagcagatcgtggagcaggtgttaaaggacggcagcgtgccggccagcggctttatcgcacccacctgccagaagaccgacggcggctccttcagaaccatggagagcgacggttatccggcggaagagtacggaatcaaccccagacaggccaatgttgaggctgcgaagcaggaactggccgaggccggatatcccgacggcaaggacttcccggctctggaaattacatacgccaacaacgaccgcaacaaaaagacctgtgaggccattcagcagatgctggaggacaacttaggaatcaccgtaaccctgcgcgcggaggagtccagcgtgttcacttccaccaagaacaagggcgactaccagatggccaccggcggctggaccaacagcccctacgatgccagcggactgatcaagctgttctactcccagaacggcaacaacactccccagtggagatggaaaccgtacaccggagctccccatgacaccaccttaaacccgggcagcgaggcgtttgatatcgcgtttgacaaggctcttgcgtcccagggcgcggaccgtgacaacgcctggatcgaggcggagcaggctctgatggcggatatgccggttaccccgctctactatccgtcctatacggcggtggtcaacgaggacctggtcgaggatgttgagctgacggcgagcaatacctttatgttcaagtcagccagtgtgattgaataagcggacagactgacggaggccggtagggataccctttgccggcctcccgtttttacacgcgccgcatgcgtttgtgcggaaccgggccccgccctgtttcgtgcccgatgtacatgaaaggagccagaaaatgcttcgatacatattaaagcgggtcgtatccgcgattatcaccatttggtttatcatgaccctcaccttcttcctgatgaaagccatcccgggcgatcccttttcctcagaaaaaatggcggaccccgtgattattgaaaatatgaaggcgaaatacgggctggaccgcccactgtccgaacagtatgtcaaatatctgtccgattacgcccacggcgatttcggaatttcctttatgaaaaagggactcacgaccaacgacatcatttcctccggatttccgtactccctgaccatcggaatctgggcctccgccattgtgcttctggtgggagtgtttttcgggattatcgccgcgctgcggcaaaataaattcgtggaccggctgctcatgttcctgtccaccctgggcgccaccatacccagctttgtgtttgccacgggctttttgttcgtgtttagcaagattctgggcctggtgccctcctacggcgtgaacaactggaagggttacatcggtccggtgatcgtcagcgccctgttctcactggcctacgtggtgaggctcatgcgcacctccaccctggacgtgctgaatcaggactacatccgcaccgccagagccaaggggctgccggagtggaaggtgctgggaaagcacgccatgcgaaacgcgatccttcccgtggtcacctacatcggacccatgttcgcggctctgatcaccggctcctttgtggtggagaaggtgtttggcataccgggaatcggaaacctgttcaccaacagcattttaaaccgcgactacaccctgatcatgggcatcaccgtgttcttctccgtgatcctggtgatctgtattctggttgtggatatcctttatgtgctgattgacccgagaatcaagtatcaataggtgttaggagacagagcatgacaaatgaaaacgagctgaacaatcttcctgccgaggtctgggaacctctacagcagcaggaaaaagatgcagagaaaattgaaaggcccagcctcaccttcttccaggacggttggagacggctgaaggccaacaaggtggccatggtttccatgatcgccattgtcgtcatcaccctgggagccatcgtgatcccctggttctggccctacagctataaacagcaggatttaaacctggccaatctgccggcggttatgaaggtgtacccggttgacgaagagaacagtatctatgtgacgccccagtacatgctgatggtggtcagccccaagggcgagctaaaggggctggcggaggccacccgcaaggacatggcccagaaaaagaattatttcgacatcaacggcaaggcggttgtggtcgactacagcttttactccgatgcgctgaaggagtacaagaagctggaaaaatcggcgaaaaagagcgggaacaacatggttcaggtgaaaaaagccgattatcttaagcagtatttcgagggcacggacaccaaggagatcagcctgagcgaggcccaggatatactggagaacaagatggcccgcacccaggtgacctgcgacggggaaccgctgacccaccaggtgagcgtcaagaaccagacctatcttctgggcaccgacggcctgggccgcgacctgttcatccggatcgtgtacggcgctcggatctccctgttagtaggctttttcgccgccttcatcaacttcgtggtaggcgtgttctacggagccatcgcggggtacgcgggcggacagacggacaacattatgatgcgtatcgtggacgtgctggattccattcccatgacgctgtacgtgattctgatcatggtggtggtggggccgggcatcgtgtccattatcctggcgctgggcctgaccttctgggtgaagatggcccggatcgtcagagggcaggtgctgaccttaaagcagcaggagttcgtcaaggcggccatcgtcaccggcgcggacacccggcggatcatcaccaagcatctgatccccaacatgatgggtcccatcatggtaaacatcgcaatgcagattcccagcgctattttcaacgaggcgttcttgagcttcgtgggtcttggaatctcggcgcccatggcttcctggggcacgctgtgcaacgacgccttggccggaatctacgtgtatccgtaccagatggtgttcccggccatcgccatttccgtaaccattttgacattcaacctgttcagcgacggactcagggatgcctttgatccgaagcagagaaagtaaagataggaaggagcggtacaatgaacgaagaattattggaagtaaaagggctgcacacttctttctttactcatctgggggaagtaaaggccatccgcgacgtgagcttttccgtccataaaaacgagatcgtgggtattgtgggagagtccggcagcggcaagagcgtgaccagtttgtcaatcatgggacttttagcccacccgggcagagtgaccgggggtgagattctctttaagggcgaggatctgactaaggtgaaaaagggccggatgagaaagattcagggcaatcagatttccatgattttccaggatcccatgacgtccttaaacccgctgttcaccattggaaaccagatcaccgaggccattctgacccatcagaagatgaccaaggcggaggcgaagaaacgggccgtggagatgctgaagctggtgggaatcccttccccggagaagcgctacgagtccttcccccacgagttttccggcggtatgcgccagcgcgccatgatcgccatggccttatcctgcgaaccggaccttttgatcgcggacgagcccaccacggccctggacgtgaccatccaggctcaggtgctgtccctgatgaaggagctcaacgagcgccttgggaccgccaccattctgatcacccataacctgggttgcgcctccagcatctgcgacaagatcatcgtaatgtacggcggcaaggtgatggaggaggggaccacggaggaaatcttctacgagcccagacacccttacaccatgggactgttgaattctatccccaaagtgacgggggaggagtccaagcagcgcctgattcccattctcggcacgccgccggatatgctcaatccgcccaccggatgtccgttctaccccaggtgccagtttgccatgaaggcctgcgcctccatgcaggtgccggagcagtatttaagcgaaacccaccgggtgagctgttttatgtgccatcctcaggctccgtccaatccaatgtatgaggcacagaagggaggaatccgccgtgaccaatgagattttgctggaagtaaagaatttaaaaatgtatttcgagaaccggaaagggcttctgggaaaacagattgagtacgtgaaggcggtggacgacgtttctttccagatccacaagggggagaccatcggcctggtgggggaatccggctgcggaaaatccaccaccggctactccatcatgcgcctgtacaaacccacggccggacagattctgttcaagggagtggatttggcgcccatgagcgccaaggaggtgtggccgtaccggaaaaatctgcagatgattttccaggacccctacgcttctttgaatccccgcatgaccgtttcggacatcatcggggagcctctggacatctaccatctgtacgaggggaaagagcgccagaaccgcatatatgagctgttaagcaccgtgggcctgggcaaggaccacgccagccgttatccccacgagttctccggcggccagcgccagagggtgggcatcgccagggcattggctgtgaacccggagtttatcgtctgcgacgagcccatttccgccctggacgtgtccattcaggcccaggtggtgaacatgctggaggatttgcaggccgagctggggctgacctatctctttatcgcccacgacctgtccatggtgcgccacatttcccgcaaagtgggcgtgatgtacctgggatccctggtggagttcgccgagaccgaggagctctacacccacaccctgcacccctatacccaggccctgatgtccgccgtcccggagctagacccggccatcagcaagaacaagaaggtgcagatgttaaagggcgatattcccagccccatcaacacgccgccgggctgcaagttcgcctccagatgtccccacgccaccgcgcgctgcgcagaggagcggccggaattccgggaggtatcgccggggcatttcgcggcgtgccatttgatatgaatgtaatgggccgccggcgcagcctgcgggcgattgctgaatgtaatgggccgccggcgcagcctgcgggcgattgcttaggatttgaaaaaacattgaacaaaacaccgtccgggtgtaagatgataaaagccgccgcgctgaaagcagagcggcttttcagctaagtaaaacagggaggcaaagaagattaccatgcatgaattgacagaactgatcaaaaacgatatgaaaccggcgctgggcgtcacggaaccgggggccatcgcctttgcggtgtccacagcccgttcctatttaaaaggggacgtgaaaaagatcctgatcaagctgaacagcgggatgtacaagaacgcgtatacctgtgggattccgggcagcagccatgtgggcaatctctacgccgccgccttaggagccgtggccggggttccccaaaaggggctggagagcctggcggatgtgaccgaagccgacaacgaggcggcggagaaaatggtggccgccgggatggtggaggcgcagatgacggagatcaccagccgcattttcatcgaggcgtcggtggagacggagagcggggaagccgtggtgaccatccgggattcccacaccaacatcgtccggatcgcggtgaacggggaggtggtgttctctggggaggagaagcgcgggactgaggcggtggagaagccgctgattcactcctataccctggagcagatttatgagtatagttccaccgtggatgtggaggagatccggtttattatggatgcgtttaaaatgaactacgagctgtttgaggagggacttaaaaatcccagaacgacctacgcccggtatctgttaaagaaaaacgggggagagattttctcggcggatgagcaaaagacggcgtcgctgctgtgcaatgctgccatcgaggcccgggtgatcgggctcgacaagccggccatgagtattacggggtccggggcccacgggattatcgccacgctgccattgtacgcagtggcgaaggtgaaggggctgccggatgagaagctgctgcgggctacggcgctcagttatctggtttgtatgtacattaaggagtattcggggaaactgtcggcgttctgcgggtgcggaatcgcggcgggtacgggaatggcctgcggattggtgtatctgaaggacggaacggtggatatgatggctaagacggtgaataatatggccagcagcctgaccgggatgatctgcgacgggggaaacaagggctgcaccatgaagggcgttgtggcggtggacgcggcgttccagtcggtggactttgccatgcaggggatttttattgacaatgtgcacgggatcaacgggatgacgccggaggagacgatgcacaatatgggactgatcgcttcgccggggatggtggagacagagggcgtgattgtggggattatgagggagaagtagaattgatacgcagccgggggatgttgtcgaggaaaagaaccgggggctggcagggccgtttggctcatagtccgaaccgggggatggctctaagcccggagagggcgctccgcagggggatcgggaaaactacggcgcaggccttaagcctgcccctccgtattccctttcgctcgggcgtggagcgccctccctcaccccctgctacgcaccctctccgggctaagagccatcgaccctctcggaaaatcgccagacagccctgcccgcccccggctcttttccggctagggattgggccggctgctggcggttccacgtttgggagggggagaaaaaattaaactgctgtaccgatgttgggaatgatatcggggcggcagtttttttgatgctgtgagagagtgggttactgaaagatcgagttcgtctccggctcgtgggtgtcggcgaactggaaggcggcgcggatgttctcctggatggtctgctcgtccagcttgcagagagcgccgatcaggtagatgtggtagtaacagtattggtccagggtcatggagacgggattctcctggtagacggaaaacaggcgggagcgggcgcccatatccatgtaggccttcatctgcaggtccgccatttcgtaggatttgtggaaatcctgctcgatctgttcgtaaatgtgggacaccatgttgatcttgtgggtctgccactgggtctgctgatccttgtggtagaacagctcgatgttccggggcgtgcgcatgatccggcggtaggcgtaaatgtacatgatgcagtagcgccagtagatgttgcggtattcgtccggataggagtcgatataggccttcagctgattgaagaagtcgtcaatgaagatctccatgatcaggaatttgtttttaaagtggtaggtgatgctgcctttggtgatgttgagctcatcggcgatcttctgaaaggtggtgccgctgtagccgtactccaaaaacatgcggcccgctacctgcaggatctgcgctttcaggtttgtgttctctgcttcatttgccatttccgattccccatttcctgtttgcgcgcggctgcgtggccaggcgcgcttggttttattataccgggaaaatacctccggcgcaagattcagggggctgttaatatttatgctatacaaattatgatatgtattgtcggctggctgacataaaagatcataaaaatccgatatagtcgtgaaaaaatagcgaaaatcacaaaaatatgttgacgaatggtgaaaaaagccgtaatataggggctatacagaatgcattttgtatagcattaaaaatgggctgcagccattttttttgaccaaaagtgttaaaaaaataacgaaaagttaaaggagtaggttatgggagcagaacaaaagaagcgaaatccctatctgtccctcgcggcagtcacgcttgcgtttacatttacatttttgagccggtacatctggagtcccctgatggcggacgtgtccaatgaattcgggatcaacgccacacaggcgggcctttatatgtcggcgtttttcgccggttatctggtgacgcagattccgggcggaattatggcggaccggtatcagccgaagtacattctgatcgcctgtacggcgctgggtggcgtgatgacggcggccatgtcgtttatcaccaattatgagatgggtctggtcatccgcgtgatcacgggtatcagcagcggctgcgtgatggcccagtgctccaaagtggtggcaaccacctttgagccgaaaaagcgcgcctccgcaatgggcgtggtgctggcctcgccgccctttggcatcaccctggcccagtccatcggagcgcccttaaaccaggccgtgggctggagaaatacgttcctgatcgtagccgccatcgtggtgatcatcgtggcgctgctggccgtgttcgtacagcccatcccgcaaaaaacgtctgcggtccccgccggaaatccggctgtggcgcaggcggctgccaccaaaacgaagggccaggccgggctgctggaagggttggtgggatttttcaccaacaagcagcagcttttgctgggcgtcagcggctttatgttcatgttcgtgaccgtgggtttcgccacctggaccaaccgttacgcccagagcctgggctttacgccggtacagggaggtatgatcatcacctgctacagcatcgcggggattatcgcctcctgcctgtccggttccattgcggtgaaatgccgcatgtcccaccggaatttcctgatcgtgagcctggcggccatgggcgtgatgacggtgctgttctccatgcagagggggtatgcggggctgatcatcgtgggctgcgtctacggggccatttcctatctgccctccacccactacaccacctcggccatgatgctggccggagagcggtacacggccacggcggcttccacccagaacctgctgtttcagctggccagcctgatcatgccgatcatcgtgggacgggccatcgaccttaccgggagctactcgtttgtctggtacattttcctgggctgctccgtgatcgcggcggtgttctgcctctttgtaaagaacgaccggcagccgtagctgcatactgaaaggagatagatcaatatgaaagaaatcactcagaaaatcattgcgctcacagtaaacggcagagcgtatgagataccggtgggggacggcaggaccgacatgccggagagcgagaccctggcccacaccctgcgggaccgtctggagctgaccgggcttaagatcggctgcgaccagggggcctgcggctgctgcaccgtaattatggacggcagggccgtgacctcctgcatgaccctgaccatggactgcgacggcgcggacatcaccaccatcgagggcctggcggaccgggccaccggggagctggacggcctgcagcaggcatttttagacaactgcggttaccagtgcggattctgtatccccggcgtgattatgacggctaaggcgttgctcaatgagaacccggagcccacggaggaggaagtgcgggaggctctggccggcaattactgccgctgcggcacccattacacggcagtggaatccatcatggcctatgtggatcagaaccggaagaagagggaggagcaggtatgagcgaattgaaatatgttggaaaagagacaaaacgcctgttgggcccgcagatcgtgacgggaaaggcgatgtacacgggggattttaagaagcccggaatgcagtacggcaagattctgagaagccctcatccctacgccaggctggcggagatcgacacggagaaggccaaagcctatccaggcgtctccgcggtggtgacctggaaggatgtggaccggaatattttcatcaccaacggtttcaccccgccaaagcaccatcacctgatggacgagtacgtgcgctttgtgggggacgcggtggccctggtggtggcggagacggaagacatcgccctggaagccatgaagctcatcgaggtgaaataccaggtgttaaagcccgtgttcaccatcgaggaagccctggccgaggatgcgccccagctttaccccgagctccccggaaatatcgcgccccacaagaataacctgaatttcgaggtgggagatctggaaaaaggctttgcggagtccgatgtgatcgtggaggtggattcctccatcgagaacggccagaacccgctgcccgtggagccgccggtgaccatctgctggtatgagaacgacacctacaactttatcgcctcagccgcggctcccgcttactgccaccagaacgtggcgtcggccctgaacgtgccttacgagcaggtgcgtctgaccgctccggccgtgggaggcagcttcggctccaagctctacagcggcaacgtgcagcccctggtatttgcggccgtcatggcgaaagcggcccgctgtcccgtgatgttctgctacaccaaggaggagcattttgccatccatcagaaccgcatggtgaccaacgcccacatccggttcggaatgaagaaaaacggactggccagcgccgtggagatgcgccagtacgcggacgcaggggtgtgcgcgtccacccaggagttcatgctggcggtgggaaccaacacccttccgatcctgtgcaagaccgacaacaagaaatttgatgccgaggtggtggtcaccaaccacatgccgtcgggttccttccgggggtacggatacatggagagcacggccctggtcagccaggccattatggaagcctgcatcaagctggacgtggacccggtggactatctggtgaaaaacgccatgaaaaagggagaccgctaccacaacgccatggccgagccgcatccctggcagaacaacaagaccgcggactggagcgatctggtggtgaaaacggcggaggcctttggctggagcgggcggtttaaaggctggggcacgcccacctgggtatccccggacggaaagaaggcaagaggcgtgggtgtgggcgcagcgggccactcggacacgggcggaaagccgagcaacgccaatgtgaccctgaccggtcttggcgccgtgtacctttccacctgtatggcggaattcggcgcaggaaccagggacgtgatgttgaagatcgtggctgaagagctggatatgcccttagagtgcatccgggtttccgacgcggacaccggcatgacgcccccggacttcggctccaccggctcccgctccacctactgcggcggcatcgtggccaagcgggcctgcgaggatgtaaagcgcaagctctatcagctggcccacgagaaattcggcgttccggaggacgatctgggctttaagggcggcaaggtttaccggctgtccaaccccggggagacctacctgctgttcccccatctgatgggcaaggtggacagcgtgaccggctgcggacgctttgagggcgtgcacaacagcacaattttccacctgcagtttgtggaggtagaggtggacctggaaatgggcaccttccgcatcgtggaccacttcggcggctccgacgcgggcgtggtcgtgaacccgctgcccctcagaaaccagctccagtccttcttcgccggcatcgacatcgcctgcatggaggaaacggtctgggatcccaatgactaccgcgtgttaaatcccagcaacatcgactacaagaccagaaccttcaacgacgtggtgaagcacgatcacattgtgctggaatccatgaagaacagcgaaaacgactacccattcggcgcggtgggcgtgggcgaaccgcttttggcccccggcggcccggcgatccgcatggccatttacaacgcctgcggcatcaagctgaactcgtatccgttttcgcctgccaaggtgattcaggcgctgaaggaaaaggagggaaaatagatgaaaaattttacatataagaacccggcgtctgtggaggaggcggttagtttcctgatggagccgggcacagtagccatgggaggcggaacggatctgctgggagttttaaaggacggtctgctgccggaatatcccgggcaggtggtgaatttaaagaacatcccgggtttaaaccgcattgaggagcaggaggacggcctgcacatcgtggctgcggccaccctgcgggacgtggcggattcaccggttgtggggagccgctggcccgcgctgcagaccgcggccaaaagcgtggcaacccccaatctgcgcaacacagccacggtagccggaaatatctgtcaggatatccgctgctggtattaccgttatcccgacattctgggcggtaagatcaactgcgccagaaagagcggccacctgtgttccgctatgatgggcgagaaccgttaccactctattttcggggcggccaaagtgtgcgagactccctgtacggggaaatgtccggcccacacagacatttccgcctatatggaaatggtgcgggcgggagagtatgagagcgcggcccgggtgcttttggaggtcaatcccatgcccgcaatcaccagccgcgtctgcgcccacttctgcatggagggctgtaaccgcaacacctatgacgagagcctgaacgtgggaagcattgagcgtttccttggggactatattctggagcacgcggatcaatttctcacaaagccggagcgggagaacggaaaacacatctccatcgtgggttccggcccggcgggactgaccgcggcctgttacctgcgccagagcggttaccgcgtgaccgtgtacgagaaacagaaggaggcgggcggctgtctgtcctacgccattccggcctaccgcctgcccaaggagatcgtacgcaggttcgtgggagcgctggaacatatgggcgtcgccttccggtgcggctgtgcggtgggaaccgacatccagctggaagaaatttatcaggacagcgacggcgtgatgctggataccggcacctggaaacgccccctgatcggcctggcgggcgaggaactgacccggttcggcctggaatttctggtggacgtgaacaactatatcctggaaaaacccggttccgacgtggtggtcgtgggcggcggcaacgtggcaatggacgtggcgatcacggccaaacgtctgggcgcgcccaacgtgaccatggtctgcctggagcagcgggacggcatgccggccaacgaggaggaggtcacccgcgccctggaggagggcgtggtgatccaaaacggctggggacccaaggaagtgctgcgccgggatggagcggtcagcggcattgtgttcaagagctgtccaagagtgctggatgagaccggccgcttcaatccggtctacgacgaggacaagctgctgacattggatgcggacatcattctcatggccatcggccagaaggcggacctggagttcttaaacggcgcttacgaggtggagacggagcggggcagaatcaaggccctggaaggcaaccgcaccagtgtggacggaatcttcgccggaggcgatgtgaccaccggcccggctacggtgatcaaggccatcgcggcgggcaaggagaccgctgtggccatcaaccgccactgcggcctggaaccgctggaggtggagaaggcgcaggaagcgcgtgaggccgccaagctggcctcctttgatctgggctgccgccacagccgcagcgcggtgaagtccccgctgctgccggtcgaagagcgcggtatggacaaggaggacatgggagacctgcctgaggaggcggtccgcggtgaggcctgccgttgctttaactgcggctgtctggccgtgaaccccagcgacatggccaacatgctctacgcctacggcgccagggtcaggaccagcctgcgggagctggacggagcggtatttttcgccggttccacccgtgtgaaggatattttaaagccaggggagatcgtgctggagatcgtggtgcccaaacctgagccgggtacggtggcggtttacgacaaataccgcgtccgcaaatccatcgattttgcggtgctggccgtggcaggaacctaccgcctggaggacggtctggtgaaggagatcagcctggtgctgggcgccgtggctcccatccccatgaagatgaccgaggcagagaactacctgcgcggcaagacgctgaatgaggagactgcccgtgaggcggccgagatcgccctgcggcacgccatcccgctggaaatgaatggctataagatcgagatggccaaggtgatggtacggcggtttctgggattttgaaatcgggcgggacggcataactgagggccggtgggctggagcgcggcctgcccgcccggcctgccgggacaaacaggcccttacggtcgaaggaaaggaagaggaaaatggatcgggaaaaaatcattttatacagtgaaaagacggaaaacctgggggagccggaactatttctgggcagaggcgaggcaagggagccgggctgcggggatgtgctggccatgttcgtggataccaggcgtgagattatcacggagtgccgttttacgatcaccgagtccgcctgcccgcccttaaaggcctgtgcggcccgggccgcagagctggcgcttggaaagccggtgatggaggcgtatctgatcagcgccgccgccctctcggagtttttcgggggcctggaacaggagagcatccactgcgcgcagatggcggagatcgcccttaaacggatgttgaaggactatgcggtccgcagagcggaccggatggctcagatgagcggcaggatgacggaataggcggctgcccggaagtgaagcccgggggcgtttcggccgtccggcggcagagggcagagcgttcccggaggccgtccggcggcaaagggcagggcgttcccggaggccgtccggcggcaaaggcggatgcgcttgacgcccccggctcatgaaatggaggagtgtggaatgaagcggacaggagcagtgattgcagcggcgggactttcctcccgcatgggggccttcaagcccctgcttccctttggggagttcagcgttgccggacatctggttgccatgttaaaagcggaacatgcggacccgattgttgtggtgaccggattccggggggaggagctggaacgggagctggcggacagcggggttttactgatccgcaatgaacattatgagacctcggagatgatggattcgctgcgtctgggtttcggggccatcgcagagctctgcgaccagattctggttatgccggtggacgtgcccgcggtgaccggggccacggtgcgccgtgtgatggagtgcgacagccccatcgtccgcaccaaaagtatggaccgctatggccatccggtgaagctggatcggaagatggtgaagctggccatggcgtaccaaggggacgacgggctccggggcttcttaaagggccaaaaggagctggtaagggacgtggtggtctacgacgaggggagctttacggacgcggacacgcgggaggagtaccggcgtcttctggcgttaaacggcagccgggggaagggatatcccgacggagaggccttaaaatggctgctgcaaaccagcgggatgccggagacggtgcggcgtcacagcgaggcggtcagccggaaggctctggatatggccgtccggctcagacgttttggaatctgtttgaacctggagctggtccggtctgcggctctgctccacgacatcggcaagggccagcccgatcacgcccggcggggcgctgaaatcctcagcagaagcggttatcccctggcagccgagatcgtgcgccagcaccacgatctggattgtataccacaacaggcggacgaaacgctggtggtatacctggccgacaagctggtgcagggcgagcgggaggtctccctggaggaacgctttgagcgaagccgcgtcaagtgcgcgggcagccgtgaggccatggagcattttgagcgccgccgccttcaggcgcgccgggcgcttcaggtgtgggagagcagtatcgccatttgagcggtagaatgacaaaatcgtgagagcacccgctgcgggtaaaacggaagtccgtctgggcttgccgtccgcagcaggtgctcttattctgattcagccgcccgcggcgtctgctctctttttgaagccgtacctcacccggggatgtccggtcccgccatatcccgccgttctgtgcgaatttccgccaaagacaaggcgttcgactgaaaacgtgcttgtattctccccgtcctctgtgctacaataggtccaggaatccgggcgtttttggacagacttccggacctgtgaagagagaggttgactatgtatacgtttgacagcagggtgcgctacagcgagaccgacgaagagggcaggctgacggtgaccggaatcatcaattatatgcaggattgcagcacgttccactccgaggatgtgggcgttggcgtgggatatctgggcgaacaccgcagaatctggctgctgtcctcctggcagattgtcatcgaccgctatccgcggctgggggaacggctgaccgtgggaacctggcacaacgattttaaaggcatctacggctaccggaattttgtgctgcgggatttggacggaaacgactgcgtccgggcggcttcggtgtggtttttatacgatttggagaaggaacagcccatccgcgtgaccggcgcggacacggatccctacggggagccggagcccaggctggaactgggcaaggcgccgcgcaagattccggtgccggagcacctggaagcggtggagccggtggtggtggcccgccatcatctggacaccaaccatcacgtgaacaacgcccagtatgtggaaatcgccagggaagctgtcccggccgggattacaatccgggaaatccgggcagactataagaaagcggcgctgctcggcgacgtgatcgtgccccgtgtggcctgcggggaggacaagtgttacacggttgtgctggggagcgaaacgggggagatctacgcggttgtctggctgagagcagaggcgtagcgtttacaagtatttttatagaagggacggaaccgaagcaggcagccgtccggccatacagatgagaagcagcaggttggagcaaggcgccgtccgcgggcggcagacctgggaaagaggagcaacgggaatgattgagttaggtaaggtacaggaactggaaatactgcgcacaaaagaatttggcgtctatgtgggcgagaaggcgggggatgaggcctccgtgcttctgcccaaaaagcaggtgccccagggagccaaggttggggataaggtggaagtgttcatttataaggattcctccgaccgtttgatcgccaccacgggaaagccaaagctgcaggtgggggagaccgccctgctggaggtcaaggacgtggctaaaatcggcgcgtttttggacatggggctggaaaaggatcttctgctgccctttaaggaacagacgcacccggtccgaaagggggagaagtgtctggtgaccctctatgtggacaagagccaccgcctggcggccaccatgcgtgtgtactcccacatgagcaatcagtctccctacaaggcggacgactgggtgacgggtacggtctatgaaatcagcgagaagctgggcgcctttgtggcggtggacaacaagtattacgggctgatcccaaagcaggaactgtttgggagcttccgcgagggcgaggagattcaggccagagtgatgaaagtgcgtgaggacggcaagctggatctgtgcgcccgcgacaaggcttatattcagatgtcgtcggacgcggacaaggtcttaaaggtcattgacgaattcgacggagtgcttccctttaacgacaaggcgaagccggaggtgatcatgcgggagtttaacatgagcaaaaacgccttcaagcgggcggtgggacgtctgctgaaagagggtaaggtgaaaatcaccgaaaagaccatcgagcggatttaacagtgcgggactgagcagctttccgggattccggggctgctttttttgaacgttatgggccgccggcgctgcctgcgggccgttgccgggcgtttggtatgccacaaggggcagaggtacggattttgaaaggagaaggttatgagaaataagagtgcggcggtggattacggtatgattgtgatcggaacggttctgatgtccatggggatcaagaacattttcgatccggccaacatggttacgggcggcgtgaccggcgcggccattatctttaaagatatctggaacgtgcccctgtggctgagcaatacgctgctcaacatcccgctgttcatcgccgcgtttaagattatggggtggacctttatcaaacggaccttgttcgccaccgtcatgctctccgtggcattgtacgtgattccggacggctcgtttatgcaggacgacctgttcctctccgccctgttcggcggaatcatcggcggcgttggaatcggcctggtgtttctggcacgggcgaccaccggcggcacggatatgctggcggccctgatccagaagcgcatgaagcactataccattgcccagattatgcaggttctggacggactgatcgtgctggtgggcgccaccgtgttcggcatccgggcggccctttacgcgctgatcgccattttcaccgtgtcgaaaatttccgacggcctgatcgagggcctgaagttttccaaacaggcctatatcatttccgaccatcaccaggagattgcggacgcaattttaaaggaaatgagccggggcgtcaccggcatgacggcccggggcatgtactccaattcggagaaaaatatgttgttttgtgtggtatccaagaaggaaattgtacaactccgggagctggtttcccgctttgatccccgggcgttcgtcatagtcagtgacgttcgtgaagttttcggtgaaggttttattgaatattgacaggttttatcatatttaacaaacttctaacaagccattccgcggaaatttgtgatttcgagcatttttttttcctggtatacaatttagctaaatcctaaatttggattttgtaaattgtcaatatggtaaatgaaaatggtttcatgtatgatagggatagttacagaagcggtttcacttcgggaattttgagtgatccggcggttactattacattaattatgaagtgcattttttaggaggaaagaacagaatggctagtttattactgaaaaacgtaaccaagaaatatcccaacggatttgtagctgtcaaggattttaacctggaaattaaagataaggaatttatcattttcgtaggcccgtccggctgcggcaagtctaccacccttcgtatgatcgcaggtctggaggacatttcttccggtgaactctacattgacgataagctggtaaacgatgtggagcccaaggaccgcgacatcgcaatggtattccagaactacgctctgtatcctcatatgtccgtgtacgacaacatggcgttcggcctgaagctgagaaagacacccaaggacgagatcgacaagaaagtgcatgacgccgccaagatcctggatctggatcatctgctggaccgcaaacccaaggctctgtccggcggtcagagacagcgtgtggctatgggacgtgccatcgtgcgtaatcccaaggtgttcctgatggatgagccgctgtccaacctggatgccaagctgagaggccagatgcgtgtggagatttccaagctgcaccagagactggaaaccaccatcatctacgttacccatgaccagaccgaggctatgacccttggtaccagaatcgttgtcatgaaggacggcgtgatccagcaggtagacaacccccgcaacctgtacgacaagccctgcaacaagttcgttgccggatttatcggcgctccgcagatgaacatgatcgacgccaccgttgccaaggacggcgcggaagtgaccctgacctttgcgggacacaccatcgcacttcccgaggcgaaggctaagaagttagaggaagcgggctacgtcggaaagaccgttaccctgggaatccggcccgaggatctgcatgacgaggagtccttcctgtccatgtctcccaagagcgtgatcgagtccaccgttcgtgtgtacgagatgctgggttccgaggttctgctgtactttgatgtggacgataccagctttaccgccaaggtgaatccgcgcaccaccgcaagacccggcgacgccgtgaaactggccctggatctggaaaagattcacattttcgataaggacacagagcttgtggttctgaactaacaaaaagaacgtcaaatccattgacttgtaaaaaaaagcaaggtagtgtataactcccttgctttttttgtaattttgcattaaaataggaaaataggatattagattactccgactatatttggaaaaaggagagtagaagatgatttcaaatcagatactgcagactacattagatggattaaagggcattaccagaattgatttatgcatttgcgatacagaaggtaaagtgttggcatccacattcacggacgcggaagattccgagagttccattctggcctttgtggattctccggccgacagccaggtgatccagggatttcagttcttcaaggtgtttgacgagcaccagttagagtacatcatgctggccaagggcgccagcgacgatgtctacatggtgggcaagctggccgcgttccaggtacagaacctgttggtggcctacaaggagcgttttgacaaggacaacttcatcaagaacctgctgttggacaacctgctgctggtggacatctacaaccgcgccaagaagctgcacatcgataccgatgtgaagcgggtggtatacattattgagacccacaacgagaaggacgtgaacgcactggagaccgtgcgcagcctgttcgcaaccaagaccaaggacttcatcaccgctgtggatgagaagaacatcatcctggtgaaggaagtgaagcagggcgagagctacagcgagctggacaagaccgccaacaccattctcgacatgctgaacaccgaggccatgaccaaggtccgcgtggcttacggcaccattatcaatgatattaaggaagtttcccgttcttataaggaagcgaagatggctctggacgtgggcaagatcttctacagcaacaagaacgtgatcgcctacaacaacttgggaatcggccgtctgatctaccagctgcccatcccgctgtgcaagatgttcatccgcgaggtgtttgacggcaagtcccccgacgagttcgacgaggagactctgaccaccatcaacaagttctttgagaacagcctgaatgtgtccgagacctccagacagctctacatccacagaaataccctggtataccgcctggataagctggagaagagcaccggactggatctgcgggtgttcgaggatgccatcaccttcaagatcgcactgatggtcgccaagtatatgcgctacatggagagtttagattattgaatgtaatgggccgcggccaaggcgtgcggcccacatgatattagatttcggagcagcgaatgatagagatcgatcgagtaagcaagacctatgagacgggcaacaaggcgctgaaaaatatcagcctcaccatcgaggacggtgagtttgtctttatcgtggggagaagcggttccggcaagagcacgctgatgaagctgctgctcaaagagctggagcctacaaagggacgcatcaaggtgaacgacatggacttaggccgcatgccgcgccggttcgtccccaaatatcgcagaggattgggcgtggtctttcaggatttcagactcctgaaagaccgcactgtatttgagaacgttgcgtttgcacagcgggtgatcggcgttccggggcgggtgatcaaggagtccgtgccggagatgctgcgcatggtgggtctgtcggccaagtacaaggcttatccaagacagctctccggcggtgagcagcagcgcgtggctattgccagggcgctgatcaacgatccggacgtgctgctggccgatgagcccacgggcaatctggacagcttcaatgcccatgagatcatgaggcttctggacgagatcaaccagcgtggaaccacggtggtcgtgatcacccacagccatgagctggtggaggagatgggaaagcgggtcatcaccatggaccgcgggatcatcaccgacgacacgggcagctacatcacaccggaaaggcagcgcttctattatgagaattagcacattttggtattgcctgaaacagggcatcattaatatatgcagaaatatcctgttctccctggcttccatggcgacgatttctgcgtgtatttttttattctgcctttttttcgccattgtggccaatgtgcagaatgtgacccaggtggcccagtccacggtgggaatcaccgtctttttcgcggacgatttgccggaggaccggattctttccatcggggatgaaatccgctcctggggcgaggtgcgaacgatggagtacgtctccgcggaacaggcatgggaatcctttaaatccgagtattttaagggcatggaggatctggcagaggggtttgccgacgacaatcccctggcgggttccgcttcatttaccattttcttaaacgacatcggggaccaggatcaggtggtgtcccggctgcagctgatcgacggcgtgcgcaaggtgaattactccaacagcgcggtggccggactgtccagcacggccaagatcgtgggcctgctgtccgcagtgatcatcggcgtgctgctggcggtggccgtattcctgatcagcaacaccatttccgtggctgcggcgttccgcaggcaggaaaatgaaatcatgcgcctgatcggcgctaccaactatatgatccgggctccctttgtggtggaaggcgtgctgctggggctgttcggagctatgattcccctgggcggaatgtattttttgtaccagaaggccgtgctctttatcaatgagcgctaccaggtgatcacggggattttcgcaccccttccgctgcaggagatatttccctatatgaccggggtcgccatgtccctgggcgtggggatcggctttttggtgagcttctttaccatacacaagcatctgaaggtttgacgaaaaaggggcgaaagaagatgaaccgatggaaacaaatgcggcttctggctgcggcgggagtgcttgcggcgggccttctggccggtccgactgcttacgccacaagccagggcttaaaggatgccaaggaccaggtgacgaccctggaacaggaaaaaaagaaaacagaggacgcgttaaagcagctggagggcctgaaggcggacacggaaaagtacgtgcgccagctggacggcaatctaaacgaacttgcgggcgagcttaccaggcttgaggagcagatcgctcagaaggaaggggagatcgcccaggcccagaccgagctggcggcggccagggagacggaagcgaatcagtacgactccatgaagctcaggatcaaatacatgtacgagcgcggggataccagctatctggacctgattttgcagtccaagagcatttcccagatgttaaaccgggcggagtatgtgagtaagatcacggagtacgaccgggatatgctggagaaataccgggagaccaaggaggccgtggcggagcgggaggccgctctggaacaggaacatgtggagctggtggcgcttcaggactccacaaaagccaagcaggcttcggtcaagcagcttttggctgacaaggaggcggagctcaccgcctacaattctaaaatttccgccacccaggaccagatcgccggttacgaggcggacatcaaggcccaggaggacaagatgcgccagatcgaggctgagatgaagcgcagggaggaagaggcgaagaagaaagctcagcaggccggtcaaacgtatacggttaaggatttggggaatattagttttaagtggccctgcccttccagcagccggatcacctcaaacttcggggaccgggagtcgcccacggaaggggcgtccagcaatcacaagggaatggatatcggcgccagcaccggagccgacattatcgcggccgcggatggcgaggtggtgatcgctacatacagctattcggccgggaattatatcatgatcgatcacggcggcggggtcagcacggtgtacatgcactgttcccagctgttggtgagcaaaggggcaaaggtgaagcaaggccaggtgatcgcaaaggtgggatcgacggggtattccacgggcccgcatctgcatttcggaatccggtccggggggacttatgtgaatccgagaaattatgtgagtccctgacggatcaaagcaggctgcgggaagatgaagtgtagcggacagataggagacagaaagtggataatcagaacaatttcaacgagaatatgaaccaggagaacccgatgccgcccaggcgtccggagggaaacagccgtttctggcacggcgtcttagcgggcgctcttgtgacggtattcgccggtctgatcgtggtgggtatgtctttggggatttacctgttcagcaggagtatggggcggggcggaagccgcccggaggcctcccagacggggcccggaatcaccgatggcaaggagaaggctgggaacgagctggattatgaacagatcaacacgaaaatgtccctgattcagaatatcatcgaccggtatttcctctacgacgaggatatggagaatgtggaggattacatctacaaggggatgcttgccggtctggacgacccatattccgagtattacacggctgaggattacaaggagatgcaggagagcaccgagggcgtttactccggcatcggcgccatgctgagccagaaccggaataccggcctgtgcaccattgtgcgcgtgtttgagaactcgcctgcctttgaggcgggaatgaagcccggcgatatcctctacaaggtggaggataaggtggtggccaacgagagcctgaccattctggtgaacaactacatcaagggccaggagggcagccaggttcacatcaccgtgtaccgccaggagaaggacgagtatgtggagatgacgctgaccaggcggagcatcgaggttcccacggtggagcatcagatgctggcggatcagatcggctacattatgatcacgcagtttgacctggtcaccacccagcagttcaaggatgcgctggacgatctggagtctcaggggatgaaaggcctggtgctggatctgcgcagcaatcccggcggcgtgttaaacggcgctgtggacatcgcggactatcttctgcccgacaatctgacccgctacgacaagggcgaggggaaaaccatgattgtttacacggcggacaagaacggaaagggcgatcactacaccgcttccgacggccatcaggtggacctgcccatcgccgtgctgatcaacggcgagtcggccagcgcctccgaggtgctgaccggggcgctcaaggattataactgggtgaccgtggttggaaccacctcctacggcaagggaattgtgcagagcctgatgcccctgggcgacggttccgccatcaagattacggtgagccactactatacccccagcggctttgacctccacggaaagggcattgagccggacgtggtggtggaactggacgaggagttaaagacccaggcggtggtgaagcccgaggaggacaaccaggtgcagcgcgcggtggaagtggtgaaggacgagatcggagaggcgaatccgggctgagtttcgggccggtatgcggttgaaatatgaatgatttgggaggcgcagatgacggcggaaggccggggctgcgcctcctgttttgatgcgttttgtaacgcgtccttgtgtgggaaattgtaaatagattgtaggattttggaatctatgataaaatgagagacatatatggagagaaggaaaccgattgggacagcggcagcgccggaggggccggaagctgggctgtgttggggaaggcgccggggagagcgccgcccgggtggaggaacgagcagatggatatgcagagaacggccagggaaacgctgaaagcattttgccgtgcctggtatgaacagcggaatgtggagctggcggcggccctgtcggtgggggatgtggagattgtgaatcccggcggttttggtccggtccacggcgtggaggggatgacccggagtattggggaggcagttcggaagattcaggagccgtttgtctgcgcattttctgaattttgtgagcagactctggcggaaggcgtgtgcagtctgtccgtggagttgacgttatataattcccaggcggttatccaccggagtgtgtttgccgtgctcgctctggacggcggggaatggcgggttaagagcctgttcgtggcccgaagcggtggagacggggggcagaaggaacgtgaggccgggctgagctggctggaacgggagctggcggaggccaatgaggagctgcaggacatcatcaacgcgattccgggcggggttgccatttacaaggtttccgaccggtttgagaccgtgtacttttcggacggggtgccggaactgtccggctatacggcggaggagtaccgggaactggcaaaaggcgatgcggcaaatatgacctactgggaggacacggccgaggtggtctccagggcgctggaggtgatccgcacgaaggggctggccaccatggaatttcgcaaacagcaccgggacggccacatcgtctgggtccgcgcgcagatcaagtggatcggggaggaagacggtttcccgctgctccactgcgtttttcacaatattacggatctgaaggaggccaggcaggagatggatcacctggtcaattccattccgggcggcatcgccagctatcagatcgaggacgggcgttttgtgctccactacttctcggacggagtgatgaagctttccgggcacaccagggaagagtacgggcgtctggccggccgcgatgccatgaacctggtctacgagcacgatcgggaccgggtgagcgccgcggccagggcggcgctggccagcggggaggttctggacgtatcctaccgcatgcgccacaaggacggcggcctgatctggattcaccttaacggcaggcggatcgggccgttggcggaccgcccgaagttttacgccgtgtttaccggtctgtccgcggaaaaccgcctgttccagaacctggccggcgatctggcggatggaatctacgtgatcgagaaagaaaattatgacctgctctacgtcaatgagtccaagcgcttctttgcggacggaagggagagagtggggcagaaatgctatcaggccctgtacggaaaggacaggccctgcgaatactgttcgcttaagacgcgggaaccggacggactggagcacgagatgattgtgccggaaaccgggagcttttacagcacttccttcagagaaacggactggaacgggatcccggcctatgtgaagatcgtccgggatgtgaccggggcggttgagctgcgcagggagaaggagcggctggcgcagtattttgagacggttctgaaaaatctgcccggaggcgttgcggtggtccggctcgatgcgcaggggaaaatggagccggagtttatgtccgagggctttgccgccatgacggagatgaccatggatcaggcctgggagctgtaccggcgggatgccatggcgggcgtgcatccggaggaccgcgggtatgtgaaccggcagatggcggaatacatcgccggggatgagaaccactgcgagatcgtctaccggctgcgaaaaggcggcggaggttacgtgtgggtgaaaaacaccctgtccctgattgagagcgaggcgggcgaggcccgggtttattccgtgtaccgcgacatgaccagggagcgtgaggagcagagcaggctgcggcagcagtacaaggatctgatcatgcagcattaccagactcaggggccggatgccttggttttgggccactgcaatatcacgcagaaccggattctggagattatcgattacacggattccaatctgcttggaaccttcggatcggtgcgggaggacttttttagcggcctgagcagtttggtggtggacgaggaggagcggcggaaattcctggacatttatctgaataaaccggcgctggaagcgtttcagagaggggacgtggaacggcgcctggaatgttttatgcgtccgcccaaggaggagacgggccggtatgtccaggtcaatatgaatctggtggctaccccggacagcggcgacgtcaccggaattctgacggtgacggatattacccggcggaccattgtggaccgcattatgaagcagatctccgcaaagggttacgactttatctcagatgtggatctgaggcaggaccggtattacctcctttccggcgatgagctggacagcggaattaggaccagcgagggcagctattcccgacgggtggaagacgtgctcctgcacgaggtggtgccccgggaccgggcgcgcatgcgcgaggccctgaatccggagtatattttgaagagactggagcgggagagctcctacaccctggcattttccatggtggacttaaacggctgtatccgcaccaagaatatcacgatctcggcggtggacctgcgcctgtacagggtctgtgtggccagggcggatatcacggaatccgtccgggaacagcaggggatgctccatgtgatcgcgtacacctttgagctggcgggctttatcaatatcagccagagcagcctgacgctttatacccgggagacggtgctggaaaatctgcccccctattttgtggagcaatacagcgatgccgtgagccgttttgtggaccatcacgcctcgaaggcggatcaggaggaagcgcgccgtcagtttcggattgaagttatgcgggaaaagctggaggaaaaaaccggcggatacgattttctgttctcctgcaatgagaacggtcaggagcgttacaagcaggtcaatgttatgtggggcgatgtgaaccacggcaccatctgcctggtgcgggcggatgtgacggatatgctggcggccgagcgcaggaccaagcgggagctggagaacgcgctgtcgcgggccgaggaggcgaaccgggccaagagcgatttcctctctaccatgagccacgatatccggacccccatgaacgccatcatgggcatgaccgccctggctatggctcatctgggggaccaggagcgggtgacggactgcctgcagaagatctcgatttcctccaggcacctgttgagcctgatcaacgatattctggatatgagcaagattgagagctcccagatcaccttaaaccgcatgcggatatccatccgtgagatgctggggcagctctccgcgatcatgtcctcccaggccaggtcggcgggacttacgttttcaattcacgccggagagatcgtccatccctgcttctacggggatgcgctgcggatcaatcagatcctgatcaacattctgagcaatgcggtgaaatataccccggaggggggccgcgtggactttcaggcggaggagatcccgccggtgggaagggactgcgcccggtaccggtttacggtgagcgataccggggtaggtatgacggaagaatttttaaatcatgtgttcgagccatttacccgcagcaggcagaccacgcgcgtggagggaaccggcctgggcctcagcatcaccaagggactggtgaacctgatgggcggagcgatctcggtggagagcgtggtgcaccagggcacggtattccaagtggagctggaaggcgagatcgtggaggacggcggggagagctgcgggcagagcgcaggcgagccggacgggcgacagtatgcggacgaagtgaaccgcaggacctttggcgggcggctgtttttagtggcggaggacaacgagatcaatgcggagattctctgtgagctgctgtccatgtatggggccaaaaccgtggtgcgccagaacggagcccaggcggtgcgggcttttgcggaggcggctcccggtacctacgacgccatcctgatggatgtccagatgccggaaatgaacgggtacgaagccaccagagccatccgcagcatggagcggccggatgcggcggttattcccatcatcgccatgacggccaacgccttcgcggaggatgtgaaggcggccatggaggcggggatgaccgcacatgtggccaagcccatcgacgtggagatactgcggggcagcctgcgaaacgtgctggatggcagcgggaaggggcggggttaaccggccctattcccatttgaagaagcggagggaaaccagggtgcacaccccggcgatggccgccatgagaaggatcgggaggcgcacgctgtctgcgggcagccccagagaggcggcctttaacagcttgattccctgagtcagcggcaggagaccggccgcctgcctcagggggccgggcatgacctcgtagggcagcgtggctccggagaagatcagcatggggaaatacagaaggctggcgatgaccccggcggtcctggcgtccggggcgattccgcccaccatcatgccgatggagaacatggataccagcaccagcagatagcctcccaggaagccggtccacgagccgccgaaccggtatccaaagaatagggccgccgtgaggtacagggagacaaaggacacggctgcgtacagggtgtagatggcgacctgaaccagaaggatcacagccgggctgacgggggttacctggtagcgcttcagaatgtgccggctccggtattccgacaccaccagcggcagacccatcacgccgcccgcgcagatggagatggtggtgagcgccccgaaggactgttccaggaaggtatatccggctccctcaaaggcgggcttgtccccatacaaaattcccagcagcaccagtaccaccagtggggcgcagatggcgaagataaacatgtccatgccccgcagtgacagtttcaattctgttttcatcattgtcttaaatgctctcatattccgattcctcctcagtataccagaggtaagcgtcctccagctgatggcagggactgttttttatggcttccgatacggtgccgtgaaacacagccctgcctttttttaaaatgcaaatccggtcgcacagtttttccacctcgtccatgaaatgggaggtgagaaaaatcgtcatgccatggtttttcaggtccgaaaggatgttccagacctcccgtcttgcccttgcgtccagtccggtggtcagttcgtccagaaagacgacttccgggttggggatgagcgccagcacaataaacaggcgctgccgctggccgccggacagctccttcaccgggcagcgtttcctgccggacagcccgaatttgtccagcagagcggctgggtctgcgggctgccggtacagggacgtcgtgacctggcagagctcccacagcgtgatcttgtcctgatagttggcctcctggaattggacgcccacccgctcgaagagtttccggcggtccgcccccgggttgaggccaagaatggagacgctgccgttatccgcttttttagtccccaggatgcactcgattgcggtgctctttcccgcgccgttggcgcccaaaagcccgaacaccgtgccgcggtccacggacaggctgaggcggtccaccgctgtcagcgcgccgtaggattttgtgagttgttctactttgattacttcctgcatttcgttacctccttgtgattttgcaacaaaagaataccaccaacgggaacattggtggtaaagtggagggttttctatggatggaaattttttgaacgccggattttcagccgaagtcttttttcagggaggcgatccaggtttccacggcctgagccagcgtgtattgctgccgtaaaacggccatgccggtctctggaatatccggctccgcctccttttggcggatattttcttccaaatacgcctttaaggtcttgatgttgttctcaatatttgccagacagcgcgcctgatgttccggcgtcaggccagccagattgacgatcacggcgttaaagtccaggaaaaaatgaatgggcttttcggagatttccagcatgaggctttcccactgggattcccccgcctctgtcagcgagtataccgctttctccggcattttcccctcccggaccagggtacttttgatcagtcctttttcctccagctggagcactttcttgtaaatggagggggtgctgattttaacccaccttgaaatgttgcggtattcgaccagcttttgaatgtcgtaggcgcttaatggttcctgctttaagattcccagaacgattaaatcgatggttgccataaggtcctccttttgtgtctgtaatgggtgggattgggggatactgattgcgctataaaatatagtagtatagttggtgagatatgtcaagtacgggcgggtgggcagccgcagagcgtgggttttaagaggttttctgcgcttgacatatactataatttatagtattattgagttcgctactataaattatagtatattgttgagattggaaaacgaaaggagagtttcagaatgaaggagaatgagaaaaaaatggaattgctgggaaatgcgccggtgcccagggcactgctggcgctgggccttccaaccatgatcggaatgatgatcaacgcgctgtacaatctggtggacgcctattttgtgggaggacttggcacaagccagatgggggcgatcacagtggcatttcccctgggtcaggtggtagtcggtttgggcctgctgtttggcaacggcgcggcgtcctgtctgtccagactgctgggacggggcgatcgggaaaatgccaaccgggtggccagcaccgccctgtacagcagtatttttgtgggcgcgctgatcatttcctgctgtgtgatctggctggagccgattcttggacggatgggagccagcgacagcgtgatgccgtacgcgctcagctacacgggaatctatatcacctgttccatttttaacgtgtttaatgtcaccatgaataatattgtgtcgagcgagggggcggctaagaccaccatgtgcgtgctgcttgcgggcgctgtgctgaatcttgtcctggacccgattttcatctatggactggatttaggggtggccggagcggcaatcgccactgggatttcacagtgtttttcaaccctggtctatctggcctacatactggggaaacggagcgtgttccggttcagcatcagagattgccgcctgtccggcaaaatcatgtcggagattctgaaaattgggattcccaccatggcctttcagctgctgaccagcctgtccatgtcaatgatcaacgacggggcccgggagtatggagattacgcccttgcggccatgggggcggtgacgaaaatcatgtccgtgggaagcctgatggtttttggatttttgaaggggctgcagcccatcgccgggtacagctatggctcaaaaaaatatgaccgtttgggcgaggcggtgaaaatttccatcatctggtccacggttttctgcgctgtgtttgggttggccgccgcggtattttccggtccgatgatctcaaagtttaccaagggggacctggatatgatccgggtgggccgggccgcgctgcggatcaacggtttatccttcatactctttgggttttatacggtttactcgttcctgtttctggcaatggggaaagcgaaagaggggtgctttttgggcgcctgccggcaggggatctgcttcgtgccggcgatccttattctgccgggaatctggggattaaacggaatcctctatgcccagccggtggcggacgtggccgcggcgttgattgcggtggggatggcggcgtatttgtggtgggaattggctgaggagcaaaaaagcgggggcgcgggagagatgtgagggaggggatggaacgggagtataaaaatggagggtgcaggaaagaacgtttgttcttgcctgcacctatactttttggtgggggtgtgttataatttttaagaacaagatattttttattcgttgtataacgagttagactatatttaggaaaggtagttgtttgaacgtaaaatgagtaaagagtaagaagtacattttaaaattttatagaatgttagtttgtgctgctaaaaggcagctacccgaataccgatttctgtcgaacagatacacgtttcatcgggttatcaaggaggtaaaaacacattatggagttcaaattacacagtgaatatcagccaaccggcgaccagccgcaggcaatcgaagccctggtaaagggcttcagggaaggcaaccaattcgagacgttactgggagttaccggctccggtaagacgttcaccatggccaacgtcatccagcaattacagaagccgaccctcatcatcgcccacaacaaaactctcgccgcccagctctattccgagttcaaagagtttttccctgagaatgcggtggaatacttcgtcagctactacgactactaccaacccgaagcctacgtcccttccaccgacacctacatcgagaaggactccgccatcaacgacgagatcgacaagctgcgccattcggcaacggcggcgttgtcggagcgcagcgacgtgattattgtagcgtcggtgtcctgtatctatgggctgggaagtcccatcgattacaagagcatggtgatttcgctgcggcccggcatggaaaaggaccgggacgaggtgatccacaagctcatcgacatccagtacgagcgcaatgagatggatttcaagcggggaaccttccgggtgcggggggacgtgctggagatttatccggcctactccgacggggaggcgtaccgggtggaattcttcggcgacgaggtggagcgcattgcgtccatcgatacgctcaccatggaggtgaaggcgcagctgggccatgtggcgatcttcccggcctcccattatgtggtgccgaaggagaagatgatggaggccacggagaatattctggcggagatgaaggagcgggtggcgttcttcaagagcgaggataagctgctggaggcccagcgcatcgcggagcggaccaattttgacgtggaaatgatgcgggagaccggattctgctccggcatcgaaaactactcccgccacttgaccggcagcgcgccgggagagccgccgtgtacgctgatcgattatttcccggaggattttctgatcatcgtggacgagtcccacatcaccctgccccaggtccgcggcatgtacgcgggcgaccgttcgcgcaagagcacgctggtggaattcggattccgcctgccttcggctttggacaaccgcccgctcaatttctcggaatttgagagcaagatcgatcagatgatgttcgtgtccgccacgccgaatgtctatgagcgtgaccacgaactgctgcgggtggaacagattatccggcccaccggtctgctggacccggagatttccgtgcgcccggtggagggacagatcgacgacctggtgagcgaggtgaaccgggaggtggcaggccgccacaaggtgttaatcaccaccctgaccaagcgtatggccgaggacttgacggactatatgcgggatgtgggcatccgggtgaaatacctgcactcggacatcgacaccctggagcgggccgagatcatccgggacatgcgaatggacgtgttcgacgtgctggtgggaatcaacctgctgcgtgagggccttgacattccggagatcacgctggtggcgattttggatgcggataaggaaggatttttgcggtctgagacctccctaattcagacagtaggccgggcggcccgaaattccgagggccatgtgatcatgtacgcggacaagattaccgattccatgcgggtagccatcgaggagaccaacaggcggcgcaagatccagcaggagtacaacgaagtccacggaatcactcccaccaccatcaagaaagcggtcagggacctgatcgccatctccaaggcggtgacggacagcgacgaccggtttaagaaagatccggagtccatggatgagaaggagcttaagaagctggccaaggagctggagaagaagatgcgccaggctgcagtggagctgaacttcgagcaggcggccaaattgcgtgaccggatgctggaagttaaaaaaatgcttcaggatttcgaataaattgacaaaatgtacctcctttgtcatgaaatattaatattgttgtaagatggatgaaattgtatatttgtaattcattttatataatgaatatagaaaaagagtgcaaatttttcgccttaattaacaacaaatggaggagggaacaaaaatgaggcaaaagagaagaaattgtctgatattcgcattggcggctgcaatggcggtgggaactgcatttacggcgttggcagaggacacgaagatcgacaaggtgaaactgtctgtcagctatgacagagagccgaagagcggggacgatattggaaatgtctatgtaaagacagacagcagtcagttccgggtggattacgcggagtacaccaacgatacggatacctggagcgtaggggatgaacccacgatcaaagtagagctgtcggccagggacggataccgtttcgcctacacaagtaagagccattttgatgtgtccggcagcggagctgaatttgacaaggccagaaaatatgacgacagttatatggaagtgacgatcaccctgaaacggatcaccggaaagctgagcggggcggagaacctggagtggagcggaaccactgcatactgggattccctggatggggcgaagagctatgaggtgcggctggtacgcgacgacaagacggtgaccacggtggagacaaccgccacttcctacaattttggcggctatttcaacaaggaaggtacctacgtgttccgtgtgcgtgcgatttccgattacaacaaccgggtcggcgagtggtcggaggattccccggattacgatgtggatgaggaagacacctggagaaccggcagcggcagatgggtgagcgaccagaacggctggtggtatgcctatgacggaggcggttatccggcggagtgctggaagcagatcggcggagcctggtattattttgagcgctccggctatatggcctccgggtggaagcagttggacggcgagtggtattacctggctcccagcggcgcgatgacgaccggatggcagatggttaacggatcctggtactatatgaacggcagcggagagatgcagaccggctggcagtacattggcggcagatggtattatctgggatcaagcggcgcgatgtatgcgaatgcccaaaccccggacggtcactatgtggacggcagcggcgccagaatctattgattggatttgagaaatggaccgcgcggcgtgacggcagcagaataaaataacagttgaagttccaggcttcccggccggtccggggagcctggcttttttactgaatgcaacgggccgccggtgcagccggcgggcgattgcgggctgtccggcccacaacttaaacgaaggtttcccgggcgatccttataaacatttccatcgcctttgtcatctgcttttttcggggatgggcgatgaaaatatcccgcccggcggagggatcgcgcaccgggtaatagactaagggggagccgccggtcagtagcaggcggatgacggagtcggtgagaaaacagcagccaagcccctggcaggccatgtttgcgacagtggaaagctggtttaagtacagggaggtgcgggggatgaaaccggcgcggcggcagatgtccaggctgcggcggtgcatgtcgtgtccgcgtttcagcaggagaaaggcttcgccggaaaaggcggaaagatccgcgctcccggtatcgctgcaaaggtgccggccggccaaaacctcttcccgggtcagagaattttcggcaaactggcggtttagcgggttatccgaggggacggctaagagaatgtgttccttgcacagcgtttccgaggcgaacagggaggcatcgtacgctcccgcatcaaagatcaggtcgatattgtcctttaaagcttcctcatacaatgccatggagtccgattccactaactccagatcaacgccgggatagcgggacacgaatgtgtggatcaccggcggtagcatgcaggcggagaaaaaattggcgcccgccaccaccacgcgcccggagttcaggctggccatctcgctcagacggtattccagctcccgttccacagccatgattttttcgaccgcatcgatgtacagttttccggcctccgtcaggcggatgggaagcgtgttccggtcaaatatttcaaagccgattccccgctccgctttgcggatggagctgcttaaagcaggttgggagatgaacaggtttttggcggcctgggagaagcttttctcctgataaacctcgtatatgtacctcatttcttgtttcatgggcgtctcctataaattatataaatatctcttatgttcatatatgtattttattataagatgaaagactggtataatcaaggagatacgcgattgccgtcagcctgggggcagccggcaggaatcagaacttcacaaaacaggagaggatggtacagggaatggatttgctgactgagaaatttgcgaagcttggggtggacagcgccccgggccaggagaagctgcaaggggagacaatactggatttgagggggtgcaggctgccggggacgccggtggatttctcccacggggatgtggatgcctttgagccgattccggggagcaaggaagcctttgacgcagggtacctggagggcgggagacaggcttacacggagtaccgcggcagcgcctccatccgcggggatatggcggagaagctctcagcgtttaccggagcgaaaatcgatccggcaaagaacgtgatcctgacgccgggaactcagggagcgctgtttctggccatgggagccatggtggcccggggggaccgggtggcgatcgtggaaccggattattttgcaaaccgcaagctggcggaattctttgagtgcaccatcgttcccgtgcagatgcgctattttgaggcggaacatgagtcgggcctggatttgagggagctggaggaggcctttcgcagcggcgtgaagctgtttttgttctccaaccccaataatcccaccggcgcggtctactcggaccgggagatccggcagatcgcagcgttggccaggacctacggcgtgtccctgatcgtggatgaactgtattcccggcagctcttcgacgggaggggctacacccatctgtgcgctttggaggaggggccggaggagatggtcacgatcatcggaccttcaaagaccgagtccttaagcggataccggctgggcgcagccttcgggtccgaggctgtgatcgcgcggatggaaaagctgcaggccatcgtttccctgcgggccgccggatactgtcaggcagtgcttaaggtatggtttgcggagccggagggctttatggagcggcggattctggaacatcaggcgatccgggatgcgctggtggaaacgttccgggcggtgccgggcgtacgggtgcggcctgcggatgcgggcagttacctgttcgtgcagctgccgccgctggatgtttccatcggggagttcgtaaagattgtgcgccgcctggcggatgtgacggtgacgccgggaacagagttcggccccggatttacggacagcttccgcatcaatttttcgcaggataagacggcggctcttgccgcagtagatcgtcttttgacggtgatggagcggtatcgcaggtcgtgaggaggagaaatatgagacgaatcggatttttgggctgcggaaaaatcggtaaagcccttgtgcgccacatcgcagagcgggaggaaacggcggtggaatttattcaggatccaggatttacaaacgatatcggggtgcaatgccccgtgctcgcgaaggcggacgaggcggcttttgcgggggcggatctgatcgtagagtgcgcaaccgcccgggtgttgtcggaaaatctggagctgattctggctcactgcgatctgatgatgttctccgtgaccgcatttggggatccggactttgagcggcgggcgaaagcgctgtgcaggacctatggaagaacaatttttatcccccatggggcgatcctggggctggacggcattttcgacggagggccggtctggcgccgggtgacggttgagacggttaaaagccctgcgagcctgggacgtcaggataactgcaggtctgtggtctatgaggggcccacccgggaggcatgcacacattttccaagaaatgtaaatgttcacgcagccgtggccctggctggaatcggctttgaccggaccatttcccggatcatttccgacccggaggtcaccaccaacgcgcaccgcatttccttaagcggcgatggaatctccattacgctggatatcagcagctatgcagcgggagctgtgaccggggcctacaccccgtactcggcctgcggaagcctggaccgggtgctggggaacggcgcgggccttcagtttgtgtagcacgttccggccattccggcgcggcgtgggaaataaaagagcaaacgccgccgaaaccatcggaatcctgttgacaattaatctcaactaatctaaaataggaaacgtctaaggagtttgtcgagacaaactccggccgcgcaggcggtaaatcggacggaatggatgggattgtgatgaaattatgtgagtgtgagatcggcaggagctacctcgtggaggacgtactggtggatgaagccatcaccagacgcctggaagcgctgggcgtcaacgagggaactccggtgctgattttgaataaaaagggcagcggaagcgtgatcgtcaaggtgcggggaacccgcctggcaatggggagaaagctttcggagggaatctgtgtggaggaggtggcgcagttatgagccagcaggagagagcggaaggcaggacacagtacggcagcgttccctatgcggcgccacggcagccccagccccgccagattcgccacggcatcgacaaacggccgatccgggtgggatttgtgggtaatcccaactgcggaaagaccacgctgtttaacgccttcaccggcgctaagctgaaggtggccaactggccgggcgtcacggtggaacgggtggagggggagaccaactacaagggccgccccatcaaggtgatcgacctgcccggcatctacagtctgacctcctacaccatcgaggagaaggtgacccgcaagtgcattgaggacggcgaggtggacgtgatcatcaatgtggtggacgcctcctcgctggagcgcaatctctacctcaccatgcagctgatcgagctgaaaaagccggtgatcctggccctcaacatgatggacatcgtggaggagcggggcatggagatcgacatgcaccgccttccggagatgctgggcggaatcccggtggtcccggtatccgccagaaagcgcaccggcctggacgtgctgatgcacgcggtggtccaccactatgaggaagagcctcagggcgtggtcatacactacagtccccaggtggaggagaagatcacccgcatcgagggggagctgcgcaggcactacggcgagatggacaacatgcgctggcacgccatcaagtttctggaattcgacgaggtggtcacaagcgatcatcccctggacgtgagcggaattctggaccacaactatgaaaagcaaatcatcaatgagaagtacgactacatagaagaggtgattcaggaatgcctgatgaacaaggaggagaaggcggccaccacggacaaggcggaccggattctgacccaccgcatctggggtatccccgtattcctgggaatcatggccctggtattctttctcaccttcacggtgggcgatttcctgaaagggtacttccaggtgggactggactggttttcccaggcggtggccgccgggcttgcaagcgtccacgcttccacctggctgacttctctgatcgtggacggcatcatcgccggggtgggcggcatcctgaccttcctgcccaatattttcattctcttcctggccttggcctttttggaggacagcgggtacatggccagggtggcctatgtgatgaatgagaccatgggaatggtgggcctttccggcaaagccttcctgccgatgcttctgggcttcggctgcacggtgcccgcggtgatggcgacccgggcgctggagagcgtgcgcgaccggcggcggaccatcctcatcacaccctttatgtcctgttccgccagactgcccatctacgtgctgttcgcggagatgtttttcccaaggcacgcgctgtttgtggcgtactccctgtatctgatcggcctggtgatggccattctggtggcctttatcctgcacaagaattccagggggacccggtcggagaacgcgctgctcatcgagctgccggagtataagacgcccaacggccgcaccgtggccatctatgtgtgggataaggtgaaggactatctgagtaaggccggaaccacgatctttatcgcttccatcgtgctgtggtttgtgctgaacaccggcaccacgggctttgtgtcggatgtgcaggacagctttgcggccatgatcggccatgtgctggtaccggtactgcggccggcgggcctgggtctgtggcaggtggcggtggcgctgatttcaggtctgtccgccaaggaggtggtggtctccagcttcagcgtgctctatggcatcagcaacgtgaactcggccgcgggaatgggagagctgtccgcgcagctgacgtccatgggatttggcggagtcaacgcttacgcgctcatgatcttttgcctgatgtacagtccctgcatcgccgcggtggccaccatcaagcgggagaccggctcctggcggtggacgctgggtatggtgctgttccagcttttggtagcctgggccgccgcggtgctggtgttccaggtgggaagcctgctgtttggttaatcagaaaatgcctgcagcgggccggtgaccaccggcgcgatccgcagccgtccggtggaacgcgagaagagatagacgttgttggacagccgctcttccggatccacctcggagcggttgatggacgccacggtgcggctcagctcctcataattttgatctccccggtcggggagcagcaggacttcgtgtatgctggagggaaggaccacaagattggccttcatccggtccgcgaagtcctttaatatatccgtgtagagcatgcaggccgctccggagagcccgttctggttggagagaatgtacagggggtgccccgtctcccgcccgccggaaggcagcagctctcccagcgcctcaccgatggagaggatacgggcggggaacaggcggggcgtattttcatccgcaagacgggacagggtttccaggtccataccccagtgggccagatgggcgccagtgatgcgcacggtcatggcgccccgttcgtccgcgcccaggtccaggtaaaataccttggccaggtccagcacagggatatggggcagggttttaagcagttcccggttggactgggcgttgatcaggcggtacgccaccctgggacgcaccgattccgcctgttccagaagattcaagtcaaagggattgtttgccaggctctggcggtaaaggctcagaagttcgtcgagaagctgctccaggggcgttccattctggaagcgctggtaacaggagtttaagtagagggtgggcgccacatgggaacccttttcacagatgctcagcccgtccaggctcagcccgttgttgcggggaatccggtggatggtcagggcatatccgtcccccagccgtttctccatctgctgtctgactgcggataaaaaggtgtgatagagcatagatttgacctccttacaggtataaaagatttacagaaacaaaagatacataacagaagaacggcgcggacgcgccggaaagaagtgtatccagcttaatccacagatcgcggattgtcaagtcctgtaggaaaatatcgtaatttttaagagaaaagttattgtagttgacagctggaatatggtatatatagagggcagcataatttaatctgtgaatatatggaagaaaaggtcagttaacatgatgaaaatgagacaagcagttcgaagcctgctggccgctgcggcgttgtccgcggcattttgcgtgactgcgttggcggacgataccacccaattcgtccccgggaccacggtgaacggcctgggaatcggcggaatgacggtggagcaggctaaggccagcgtggaaggattttacgacagcaactaccagcttgagataaaaaagaaaaatggcaccaaggattatattaagggagccgagatcggctacaaggtgacgcttccggctgggctggaggagattctggccggacagaacgccaccgggcgcgtttccggcccagcggcggacaactcccacaccatggatatgagcacggcttacgatgcgcaggccctggaggaccggatcgcagcgcttccctgcctttccggttcggggatcgtgaccactgtggatgcgcggatttccgactacgaggccgggaaggagtttaccatcatcccggaggtggagggcaacaacctggatgcagagcggactgcggctgcgatccgggaggcggtggctgccggagaacggcagctggatctgacggcagcgggtctgtattaccaggtccaggtgcgcgcggatgaccctgggctcagagcgctctgcgataccatgaaccgttaccgcgccatgaccgttacctatcaggttggggaagagtcggaggtgttggacggcggcaccatctgctcctggctgtccgtggggaccgacggacaggtaaatgccgaccccgccggagtgaccgggtttgtgcaggctctggcggccaagtacgataccgcgggcaaagagcggaccttccacaccgcggatggccgtgacatccccctcaccgggccttacggatggaagctggatcaggccgcggaggtgcaggcgctgaccgaatatctgaagtccacggacagccagacccgcgagccggtgttcgcccagacggcggccagccggacggagccggagtggggcgctacctatgtggagatcgatctgaccaaccagcacgtgtacatgacaaaggacggggcggtggtctgggacgcgccctgcgtgacgggaaatgtgtccaagaactacaccacgcctccgggaatctattccctgacctacaaggaggaggaccgcatcctgcgcgggcccaagaaggcggacgggagctatgagtacgagagccacgtggatttctggatgccctttaacggcgggatcggactgcacgatgccaactggagaggcagcttcggcggaacgatctatcagacctcgggcagccacggctgcgtgaacctgccgccggaccgggctaagattctctacggcctggtggaaaagggaatgccggtgatctgctacaactgatgtttttacaggtgataacatggaaaatcgggacagggagctggcgaaggccgccatgctggccggggagattatgctggtcagcggggcggaaatcgccagaatcgaggagaccatccactatattttgagcgttgcggaccgggaggcccagaccatggtgttcagcaccgggattttcgtcaccctgcgggaagcgggtgaggagccggtcaccctggtgcgccgggtcacggaccgggccaccaatttaaacaggatctgccaggtgaatgaggtttcgcgccggatctgcgcgggcacgctcgccgtgccggaagcgctcacgcgtctggaggagatcaggcgcgtcaaccagtacggtttggcggcgaagggggtcagctatatctgggtggccttcttttttggcatcgtgctgggaggaacgccctgggactgcctgggagcggctctggtgggggcggccttgggcgcagtggtgtacgtttcgtcgcgcctggggctcaacggtttctgcgtcaacgctctgggggcctttgcctgcgggatcacggcgctgctgttgaaccgcttcgccctgccccagacaagccgcgacatcatgattgtaagctccatcatgcccctggtgcccggtgtgatctttaccaccgcggtccgcgacacgctgaacggggattattcctccggcgcggcgcggatgctggaggcggcggtggtggccctggccgtggcggcgggcgttggcgccagcatggccctgttccgctatctgacgggaggtggggcggcatggtaatggtaattcagacaatgggcgcgttctttgcggtggccagctttacacggattctggagctgcccaggcgcttcctgatgtggtacggaaccgcgggagccctgtgctggctggtctatctgaacgtcagggacggagccggttccaagattctggccgcctttgcggccggactggcggtggcggtgttcagtcacctggcggcccggcttttgaaggctccggtgacggttttcctgataccgggcattctgcccctggtgccgggggcctccatctacaacagcgtttattacatgattcaggacaaccagccccagtcctcccactacctggcggagacgctgcagatcgcgggagcaatcgccatggcggtatttctggtggattccctgtttcatatgctgagggcggggaagaaccgccgcgcggcgcgggaggaggcaggggagcgggctgccgcggacgttaactgcggggcgaaccgagcccccgagccccatggctgcgggaaaaaacagggctgtgatacgaaattgtgtgagcagatggaaaaatttgaaaaaaagacttgaatttttgggccaagtgtagtattatacaggagatgcgtctgtagctcagtggatagagcagtggcctccggagccgcgtgcgtaggttcgattcctatcagacgcattttttgatgcaacggcgatgccgcagaactgggagttatactcctggttctgcggcattttgcgcatccgggggttggcggggggaggaaagtgggacggcttcggcggcgaggtttccgtacgtctgggtctgtcctgcgaacaacccgcacgccactccgataaattccgcagcagcagcggtcagctcccgcgcgggatcacgggcgatcacaaaggtctgccgggcctgcaggtccttcaggcggtagcagacgatttttttgcccaggtcttcggatcggaccagagtggcggggatgaagcccacgccggtgttcttggcgatcagcgcgtacagcgtgtccagggaattgatctcgattaagtttaccgggggaaagagactgccgcagatgtccaggcagaccccggcgaacttgccgtttttccgggtgatgataaaggtctcgttctccagcagcgccagctcacggaaggtgagcgctcctgggggaaactggctgacaaaggggtgggacgcggggagcgccagcaggatttcctcggagaacagtttgcgggccgctagcttgggggagcggacgggcagcggcatgatacagaaatccagagcgcctgccagaaccttttcttccagctcgtccgagtgggcgctgacaaaggtgatgctggtctggggatagctggcggaatagtgcttgaccagcatggggatcacatacttctcgtggagtgtggtgatccctattttcagattgcggcggtccgcctgggcgtaaccggccagggtttccttcatcgtccggcagtgaaagagaatggtctgggcttccgccaccatggcctgtccggcgggcgtcagagtcaccccgccggtttggcgggccagcagcgggacggaaaattcccgctccagacggctgaccgcatggcttagggccgattgggtgattcccagctgcctggccgcccgggagaggcttccgcagccggcaatctgcgtcatgtaatacaggtcttttaacagcatcggaatccctcctgtgcgcttcaatgggtatgaatagtattcatgtacatattgtatatgtatattttataattgtcaattaatatggtaatattgaataaaccaaacggaaattcagtttatttttgaagaagaaggaggatttattatgtggaaacggttgggaagtctgatgcttgccatgacggtggcggggatgtgtttagcgggatgttccggggggacgtccgcccagtccgggaaaacgtacccggagcgcaaggttgagattatcgtgggctttggagccgggtccggcacggacatcacggccagagccctgagcgagccgctgtccaaggtgctgggggtgccggtggtggtgaccaatatcgagggctcccaggggctcaacggcctggaatatgtgtacaagcagcccgcggacggctatacgctgtttctgaccacccagacccagctcatcacccagatcaacggcttatccgagatcaagttcacagaagagttcatgccggtcagccgcctggtgcacgacgtgaccctgatcacgggaaacggacagggccggtttaaggattttgacgagatgaaagcgctggcggaggccaacccaaaggatgtaaaaatcgccggtttggcggccaccggcctggacggtatgatcattaagcagttcgtggaatcttccggactggaactggatctgatcagcttcggggggacgggagagtgcaagtccgcgctcctgggtggacatgtggacctgagcatcgacgacgtggccacagccaagcctctgattgaggacggggagctgaccggcatcgtggtgctgtccgaggaacggctgcccggccttcccgacgtgccctgttccgtggaaaagggtatcgacgccaccataggcgcatggcgcgggctttcggtcaggaaggggacggaccccgaggtcataaagaccctggaagaagctattgtaaaggccatggaggatccggcctggaaggagtttgtggagacggggatgttggaccagagaccgggttatgccaattctgaagaatttggaaagatttgggaagaggagtatgcattctttgagaccatggtggaataggagaagggaaaattttggattgagagaggggatggtgtgatggcgggagatattgcggtgtgcgcgctgctgatactgttttgcctgttttgtctgtttaacctgatgttcggcatgggaaatgtgatggattacgatccgatgggccccagggcctggccggtgtttctgctggtgctgctgatcgcgctgcttgcgctcaacatattcctgtcgcttcgggcagcgcggcggcagactgcggcgggggaagccgcccggacggaacgcgcgggggatgggaggaaactccaaaagctggcctggtcggcgcttgggatgttcgtctacattacgttgatggacaagatcggatttgtgttttccacgccgctgttcgttgcctactatatgacgctgctgggaaaccgcagctggaagatgcggcttttgaccgcggcgctgtccacagccgcgctgtacatcctgttttcgcggtttttgcaggtgccgcttcccaggggatacggaatgttccgggatctgtcgctgttctttgagacgctgtagagagggggcgggtaaatgtttgatatggttgcaaccggattctccattgtgctggaaccggccacatttttaattatttttctgggaatcatcgcgggtacgatattcggctctatgcccggggtcagcgcctccatggccatcgccctgtgcgtgcccttcacctatgtgatgaggcccgtggtgtccatcgcgtttctggtggcggtttactgttcgtccatcaccggcggcgggatcacggcgattctgttcaagataccggggacgccctccagcgctcccaccacctttgacggttacccgctggccgtccagggccgggccggggaggcgctgggaacctccatcatctgttcggccatcggcggcgtggtctcggcctgcgccatgttcttactgtccccgcagctctcctcccttgggttgaaattcggcccgtcggagctgtttgcggtcagctttctgggactgagcgttctgacctgcctggagccggacaatatgctcaaaaccctgatctccggtctgctgggcctgttcatcgccaccatcggcacggaccccattgtgggctgcgccaggctgacctttggccggacggagcttctggggggctttgacatgatcccgatcatgattggtatgttcgcggtctccgaggtatttaaacagaccattaagcccatcagcctgggggagatggtgggcggaggaaacaaggtcaggacgaagatgatcagcttccgccagatgatggagatcaagtggaccgtggtccgatcctccattctgggaaccgttgtgggaatcctgccgggggcaggctccaccatcgcagcgtttttgagttatgtggctgaggttaagacctccaaaacgccggaacgctatggaaaaggcgagctgcggggggtagcggcctcagaaacggccaacaacgcggccaccggcggctccatggttcccctgctgagcctgggaattccagggggaaacgcggcggctatcatgatgtcagcgctgatgctccagggcgtccagcttggtcccattttacagaagacccagccggaatttctttccagcgtttacgcctccatgatcgtgaccaacatcctgatgatcgtagtggccgtggcggtggccaggattttcagcaagatcatgaacgtgccctacgccattttgggaaccctgatcgcggtgtttgcggtgatcggcagcttcgcggtgcagaacagcgtgttcgatgtctacatcatgctgggagctggccttgtggggtatgtgttcagcaaatgtaagttcaatccggcggccctgattctggggctggtgctgggaaatatctgtgagtccaatttgcggcgcgcggtgaagctgactcagggggatgtgatcctggcgctctccaagcccatcacggcgtccttgctggcgatctgtgtggcggtgctgctgtatccggcggtgaagaaaatgctgtcctcccgcagcgctggaaccggccgggccggaaaatctgagaatcagtcaaaataaaaatgtaagggatagaggagataggatttatgaaagagaagattattttaagccccattcagatcgggccggtgaccgtcaaaaaccgggtgatgttcccatccatgtgcacgttcttctgtgacggacgtggttatgtcacggaggaccagatggactttgtggaagatctggcaaagggcggggcaggacttattgtggttccgggaagcccccacggaaaaccggggccgggccgtccggctctgtccgacgaccggtatatgccgggctggaaggccatggcggatacggcccaccgctacggcgcgaagctgttctgccagctccacccggcggcggtccaggccggccgcgacaaggtggtgaaggcggtggaggattacagcagggagtttctggccgagctggtggacagctatgccagggaagcgcgccgctgccagctctccggcgtggacggggtggagatccacggcgcccatgcccacgagatcgcccagttcatgtctccgcggtataaccggagggcggacgagtacggcggggattatagggggcgcgcccgctactctctggagatcgtccaggcgatcaaggcgatctgcgggacagagtacccggtggtgttccgcataagcggagacgagatggtggagcgggggaggaagcttccggagaccattgagatcataaagctcctggaggaagcgggcatcgacgcggttcacgtgtccatcggcatgccggagtccgaggagtacatgtgcgcccccatggatatccctgacgggttcaacacgtccgctgccgaggcggtgaaacgggaagtaaaaatcccggtgattacggtggggcggatcaccaccatggagcaggcggaggaaattttagagcagggcaaggcggatctgacggccatcggcagagcgcagctggcggaccccgggctggtgaacaagtatatgggggttgatcccgcgccggtacgccggtgtatcggctgcaatcaggggtgccgggccgccaccgtgcgcaagaagatccgctgtatgcagaatgtgcggatcggcaacgagaaggcgctgaccttcgtcccgccgtctccggcgcttgaggcgaaaaaggtggtgattgtgggcgcaggtccggccggcctggaggcggcggctatgctggcggagcatggggtgaagaatctggtgatttttgagcaggagagccggccgggagggaagatcaatctggcccagataccgccctttaaggccaacatggaatttctgaccggttaccggctggatgtgttaaaacgccacggcgttgaaatccgcttgaacgtccgggcggacgtatcgacgatcgcggccgaggcgccggacgcggtgatcctggccacgggcagctcgccgctcatcccgccgatccccggcatcgagggggcgggcatctacacgggcgaccaggcgctggagagcggcgtggagccgggagagcgcatcgccattctgggcggcggcctgatcggctgcgagacggcggagtatttcgcctccatgggcaggcaggtggaaatctttgagatgagggacgatgtggccgtggagctgacggagagccggagaatctttatgctgaaacggctgaaggagctggagatccccattcacacggggacgagggtggaggagatcgcccttccgcgtctgaccgtaacggatggacagggggagaaacggcagatggatggatttgacagcgtgatcgttgcagccgggcgcaggccggaatcggggcttttggaagaggttcgggaggcattgccggaaacgcgggtgtacacggcgggggatgcgaacgttccggggctggctatcgaggcggtccatgaggcggccttcgcggcggcggaaattttgagagaatttgcatagtcatacaatttaaaatcagggacagatttcaaagcggaaatctgtccctgactgtggtatagacctggctggcgaaggcttccacggtttttaagtggcaggacccggcggaatagaccatgaccacgtcccggcagatgcccgattctcccagggagaggtagattagatcgctgggatggggcacccgcagagcggacacgaaggtgatgccaaggccgctctgaaccatttccagggccacgtttacattgctgacggagtacagggtcctggtccggatgcggtagctgtcaaacagccggtccgtgatcttgcgtattttggtaccgggctccgagacgatgaaatccaggccggagagctgttccggggcgatccagcggcgtccgtttccgtcgccctccccctgcgccagctttaagagcggatggttgggggagacggccagaaagagctcctcgctggtgatgggatggtggataatggattcgttgttgaggggggtggagatcagggccgcgtccagctgctggcttatgatcatttcctccagcaacctggaattggcttccgtgatggagactgtgatctggggaaaattccggtggaagctgttaaggatatccccaaggaacagcacgcttttggccgccgggatgccgaagcggatcacgcccagctccagcatccgcatctgcttgagctccctcatggccgcctggtaggagcggtcgatctccttgatcttttccagaaacagctccccggcataggtggggtgaacccctaagggggtgcggtagaacaggacggttccgatggacgcctcgaaattctttaaaaactggctcagattgggctgagacatgtagagcttttccgccgcccgggagatactgccttcccgggcaatggcgaggatgtacgtcagttctttgatttcaaccatgggcgcctccctgagatgtttcgacgtttgcgtgtctgatgcgagtatagcaatggggggcgcggcgtgtcaagaaggggggaataagggcggcttggggaaaattcaggggaaatgagggagaaaaatgcttgacatccacaaaaattatgctaagatggaatcataaattggattgtaactgtttgagcaggcaagaccagaattataccagatgttccatgggcatatctgtatatttcgggtcttttttgaattctgccgtggaatcagggggagagggacatatggtgatcaaaaagatttacaacaacaatattgtcctggtggaagatgaaaagcagctggagatgatcctgctgggcagggggattgcgtttcagaagaaagcgggggatgaaatcgatccgggcagggcggagaagcgctttgtcatcgattcaccggagttgacctcgcggttttccgagttggtgaaggaggttccggtcaatcatctggagctgtcctgccgcattatcgaggacgcccagaaaaggctgaacgtcacgttttccgacgccatatacatcggcttgtcggaccacatcagctacgcgctgtaccgcagcaaacagaagctgccgctgaaaaacaacctgctgtgggagatcaaacggttttaccccagggagtatcaggcagccagggaagcgcttaagaccatcgcctactatgagaatgtgtggctgcccgacgacgaggccggttacattgccctgcacttcgtcaacgctacccaggagggcgaggagatgcagaccacgatccaggtgacggagacggttcaggagctgattaagatgattcagattcatttcaatatgagtctggatgagacgtctctgagctatcagcggctgatcacccatatccgctactttgtgcggcgtctgtttgtcaatgagccagcgggcgggggagacgatctgctgtttgagcaggtaaaaagcgcatatccgcgcagctacacctgcgtctgtaaaatccgggattatttccgcatgaaattccactgcgagatcacggaggaggagatgacttatctgatgctgcacatcaggcgagtgacctccagagaaggcacataaatcaatacggaagaggattgtaaccgcagtcaggcgggcaagaccggaagaggacagatgactcgaggcatctgcgctttttctggtcttttttcgtctgccggtttcgataaataaaacaaaggttgagaaagagaggctgctgtgatggattacaagcaaatggcacaggagattctgcggcatgtgggcggaatcgaaaatatttcctttatgacaaactgcgccaccaggctgcgtttgaattttaaggatgagtcgaaggtggacctggaggcggtaaagcaggtttcgggagtggtgggagcggtgaaaaaggccggacagtaccagattatcatcggtacggacgtgggccgggtgttaaacgaaattaatcagttgggcacgattacgggggagagctccggacatgagaagaaggagtccccggtaaaccggctgatgagcgtgatcgcaggcattttcgctcccattatcccggccctaacggccggcggtatggtgaaggtggttctgactctgctggtgttcgcaggcctggtcagtaaggagtctcagacctattatgtgatgaattttatcgcggacgcggtgttctatttcctgcccgttctggtggccatgtccactgcgggcaagctgaagtgcaatatgtatctggccggcgtgatcggtgcggtgctgctgcaccccaattttgtggctttgaccggagcgggcgagccggtgacctttatcggacttccgcttaccctgatttcttacggttccagcgtgatccccgcaattttggccgtgtggctgatgtcggtggtggaacccctggcggaccggatttcgccgaagcccattaaatttctggcaaagcctttgatcacgctgttagtggtatctccggtgacgctcatcgtcttaggccccctgggatacaccatcggtacaggaatcgccgcgggagcggattaccttaaccggaacgtgagctggctggtgcccactcttatgggcgcatttatgcccctgctggtgctgaccggcatgcactggagctttacccccattattgtacagtcttacgccagctacggctgcgaggcggtaatggggcccggaagctttgtttccaatatctgtcagggcgcggcctcccttgcggtggcgttgaaaacgaaaaacaaagaaacccgtcaggtggccacctccgccggaatcacggcgcttttgggcgtgacggagccggccatgttcggcgtgaccctgaagttaaagcggccgctgtacgcggtgatgatcggcggcgcatgcggcggcctgtacgcgggtattaacggcgtggtgcgctatacctctggcacgcccggcttggcctcctttgccatcttcatcggagagaatcccatgaatctggcgcacgcttttatctccgtcggtatcggttttgtgatcacctttgttttgacctggattctgggatttgaggaggcagctcccgcgaagacggtcaaaaaggaagcggcggagctggtgcgcaaggttgagatcgtcagcccggcggagggacagctgatcgggctggcccaggtgaaggacgagacgctggcttccggtattctcggtaaaggcgctgcggtgattccggcgagcggctcggtgctatcccctgtcaacggaaaggtgatctccgtgttccccacccgccatgcggtggggattgtggatgaaaacggcgtggagctgctgatccatatcgggatcgacacggtcaaactggagggcaggtattttaccgcccatgtgaaggaaggagatatggtaaagattggggatctgctggtagaatttgatcccagggccgtgacggcggagggatacgacacgaccatcaccctgttaatcaccaacagccaggagtttttggatgtgcttccggccaaagccggcccgattaaggctggtcagacgatcctgaccgtggtataggaggagatttatgtttccaagggattttatgtggggcgctgccatggcggcaaaccagtgcgagggggcgtatctggaggacggaaaagggctgtccatcgcggatctgctcccggatgcggcgggcggcaggtgggatatgctgtatcacccggaaccgtatctggataaaaaactgccttattatccgagtcatgaggccatcgatttttaccgccggtacaaggaggacattcgcctgctggcggatatgggaatccgggctttccggacctccgtcagctggccccggatctttccgcagggggatgaaacagagcccaacgagagcgggcttgggttttacgacaggctgtttgaggaatgccgccgctatggcatagagccggtggtgacgctgtgccatttcgacacgccctatgggctggtgagaaggtacgggggctggaaggaccggcgggtggcggatttttactgccgttactgccgggtgctgtttgagcgctacaagggactggtgcgttactggatgaccttcaatgagatcaatatgatgacccatatcccgtttctggggggtggactgctcctggacggggagcccaaccgggcgcaggccatataccaggccgcccaccaccagctggtggccagcgcggcggctaccaagatcgcccacgaggtggacgggcaaaatcgggtcgggtgcatgctggcggcggggtcctattatccctacagctgccgcccggaggatgtgatggcggcagtggagaagaaccatgagaattacctgttcaccgacgtccagtccagaggggcgtatcccgggtacgccaggcggctctttgaggagaaggatgtgagcctggaaatggagccgggcgacgaggagctgctccgggagaacacggtggactatatcggtttcagctattattcctcccggctggccgggatgggggaggaggcgcaaaagaaccgtgtggatgggaatgcggtggataccctgagaaacccttatctggacatcacaccctggggcaggcagattgatcccgtgggtcttaggatcaccatgaacgacctttttgaccgctatcagaagccgctgtttgtggtggaaaacgggctgggctgtgaggacaaaccggaggaggacggcacggtatgcgacggctaccgcatcaattacatgagagatcacattgtgcaggtgggcgaggccatgagggacggcgtgccctgtctgggttacctgccctggggcaccatcgatctgatcagcgccgggggcggtgagatgaaaaagcgctacggtttcatttatgtggataaacacaacgacgggacgggaacgctggagagacggaagaagaaatcctatgactggtaccggaaggtgatcgcttccgggggcgaggatttggaataaagagagacgggagaatacctgtcggggccacgtgaaatttaggctccgacaggtattttcctacccggaagcagccgggggaccggaaaccgccgcaatccaagattgcaatttataatagagtctgctaaaatagagcggagacattttaaagcagaacgggcgcgtttcgccccgcacaggaggacagaattcatgagtcgcagaagaaggacaggcagaggttggtctgatgaagataaaatcaaatacatgcggatgatggcgataccgctggtggtggttgtggtgctggtgatcattatcctggtgatggacaagaagccccaggagacggacgccacggtttcaggcacggacaacacggtggagatcgtggtggagcagtcgggcaccacggcggagatgagcgtcgagccggacaacagcgagtacaagacggatttctcggattatgagctgaaaaaggacgaggttcccgaggtgaaccagctgatcagcgagtatttccaggccaaggtggaccgggacgcccagaagctctacagcctgtttggaaagacggacgaggacaatctggaccagaggcagaagcagctggacgcggaggccgccgagatcgaggactaccaggagatcacctgctataccaagcaggggctgaccgaggactcctacgtggtctatgtgacctataagatcaaattccgcagggcggattccctggcgccgggacttctgtggtgttatgtggtgaagtctgaggacggacagtaccggatccgcgagaacgtggtgggcgaggaagcggactacgtggccaaggccaaccagtccgaggacgtgcgccttctggcatcccagatcaaccagcagttgaaggaagcgctggaatccgacgcgctgctggccggagcttacaagaagcttcagaagggcgcggtggtggactcctcccagccggaggagacaaaggacagcaacgtgtccattatcccgggcgggcaggagacgaccgctgcggacgggacggagacagccgggacgaccccggagggagcgccccagggcggagacgcggggcagggacaggatagcagcgacagcgccggtgacagcagcgccgcttcgcaaaatgagaccggggcaggggagagttcctccgcttccgaggtaaaaataggcgaataaccggaggcgtaaagagatggatgtaaaggattttaattttgatctgccgcaggaactgattgcccaggatcccctggacgaccgggcttcctcgcggctgctggtgctggacaaggatacgggagcggtgacccaccgcgtgttccgggacattgtggagtatttgaggccgggggactgcctggtgatcaacgacaccaaggtgattcccgcccggcttatgggcgtgaaggcggacaccggggccaagatcgaggtgctgctgttgaagcgccgggagaacgatatctgggagactctggtaaagcctgggaaaaaggccaagccgggcacggagctgtccttcggggacggactgctgaccggcaccgtggtggagacggtggacgacgggaaccgtctgatccagttccattatgaggggatttttgaggagattctggaccagctgggccagatgcccctgccgccctacatcacccaccagctgaaggacaagaaccgctaccagacggtttacgccaagcacgagggatcggcggccgcgcctacggcggggctgcattttacaaatgaactgctgaaagagatcggagacatgggagtgaagattgcccatgtgacgctgcacgtgggcctgggaactttccggcccgtgaaggtggaaaatgtgctggatcaccacatgcactcggagttttacgtggtggaggagtccgaggcagccaaggtcaacgagacgaaggccgccggggggcgggtgatctgcgtgggcaccaccagctgccgcaccgtggagtccgcgtccacggaggacggagtgcttaaggcggggacgggatggacggaaatattcatctatccgggctaccggtttaagattctggacgccctgatcaccaatttccacctgccggagtccacgcttgtgatgctggtcagcgccctggccgggcgggagcacattctggccgcttacgaggaggcgatccgggagcgttaccgcttcttctccttcggggacgccatgttcatcgcgccggatccggtggcgctgccgcggaaaacagaggaaaaatgatggaagaacgtttgaataaactgctcagcgccatgggcgtctgctccaggcgggaggcggaccggctgatcgagtccgggaaggttttggtggacggcgtgcccgccaagatggggcagaaggtgcgtatggaccagaccgttgtctgccgtggaaaagtggtggggcgcggggaagcggcggcgggggccgggaacgggaaaacggcgaggagagttgggagcggcagggccgatgggaccgccgcccaggacgcccgcccggcttccctcccacgctccatgaaaaagccaaggcccgtactccttgccgtaaacaaacccaaaggcgtggtctgcacggcttcggacaaggacaaggcgccgaacattgtggatatgatacagtatcccgtcagagtatattacgtgggccgtctggacaaggattcagagggcctggttttaatgaccaatcagggcgatctggtgaataaaatcatgcgcagcggcaatgctcatgagaaggagtaccaggttgtcgtggaccggcccgtgaccgcggagtttctggcgcggatggagaagggcgtgcggttaaaggagctggaccggaccaccctgccctgcaaggtgcgaaagaccggagacaagcgcttttccatcgtgctgacccagggcttaaaccgccagatccgccggatgtgcgaggcctgcggctgccatgtgcgctctttgaagcgggtgcgggtgatgaatatttgcctgggcgacttaaagagcggcgaataccgccaggtggagggcgccgagtaccgggagtttatgaagcttctggaacattccaccaacttgtccttccgccagcagaatgctgccagggggcgcgatcaatcggatggagaatgagaatggaagatagaatcgagagaatgaaggaacttgtctccctgctctccaaagcggggaaggcctattaccaggagagccgggagattatgagcaactttgagtatgaccggctatacgacgagctgaccgccctggagcgggagaccggcgtcaccctgtccggcagccccacgaaacgggtgggctacgaggtcctgagcgagctgccaaaggagacccacgagtcccccatgttgtctctggacaagaccaagagcgtggaagatttacaggcctggctgggggaccagaagggcctgctctcctggaaaatggacggccttaccatcgttctgacctacgacggcggaaccctggtcaaggcggtcacccggggaaacggcgagatcggcgaggtgatcacccccaacgccagggtgttcgccaacatccccttaaacatcgcccacaagggcctggtggtgctgcggggcgaggcggtgattttgtactctgatttccggcggatcaacgaggagatcgaggacgtggatgcaaaatacaaaaacccccgcaacctctgcagcggctcggtgcgccagctgaacagccagatcacggcggagcgcaacgtgcattttgaagcgttctccctggtgcgggccgagggcgtggactttgagaactcccgcaagcgccagttcgagtggttaaagagccagggcttcgaggtggtggattaccgggaggtgacggcggaaacgctgccccaggcggttcaggaattcgccgacgcggtggagggcaacgacatcccctccgacggcctggtgctgctcttcgacgatatcgcttacggcgagtccctgggccgtacagccaaattcccccggaattccatcgccttcaagtggcaggacgagatccgggagaccaagatgcgctacatcgagtggagcccgtcccgcaccggcctgatcaaccccgtggccgtgtttgagccggtggagctggagggcaccacggtgagccgggccagcgtccacaacatcagcatcctggaagggctggagctgggcgaggaggaccggatcacggtctacaaggccaacatgatcattccccagattgcggacaacttgacacgcagcggggtgaagcatattccggagcaatgtcccgtctgcggcggggccacggagatccgccaggtgaacgacgtgcgcagcctctactgcatcaacccggactgccaggccaagaagatcaagagcttcaccctgttagtcagccgggacgccttaaatatcgacggcctcagcgaggccaccctggaaaaatttatcggggccggatttatccacgagtatgcggatattttccacctggaccgccatcaggaggccatcgtggaaatggagggctttgggcagaagtcctacgacaatctggtggcatctgtggccaaagccgccgacaccacgctgccccgggtgatctacggtctgggcatcgcgggcatcggcctggcgaacgccaaggccctgtgccgccatttcggatatgagtttgagaacatgcggaaggccgatgaggaagagctggtggccgtggacggcatcggagccgtcttagccaaggcgtggatggaatacttttcctccgaagcgaacaatgaggcggtggaccacctgttcgccgagctgaccattgagaaggaggctgtggaggagacggagcagatctttgcgggaaaaacctttgtgatcaccggttccctggagcatttcggcaaccggaaggaattgcaggagctgatcgagtccaaaggcggcaaggccgcaggctccgtttccgccaagaccagttacctgatcaacaacgattcgctgtccccatcctccaagaacaagaaggcgaaggatttaggcgttccgattatcacggaagaggagtttctccgaatgctggagcccctggaataaggggcttaccggagccgcccgggcggcagaaacagcgtgatttgtagtgggctatgcccgctgccggaaaggggaaacgagatatgccgattaaagtacagagcgatttgccggcgaaagccatattggaagaagagaatatatttatcatggacgaacggcgggccatgacccaggacatccgtcctttggagattctgatcctgaacctgatgcccatgaaggaggagacggaaacccagctgctgcgggccctgtccaacacgcccctgcaggtggactgcacgtttctgatgatggcgagccatgtgtccaaaaacacgtcggccagccatttaaacaagttttacgtggaatttaacgacatcaagcgcaggaagtacgacggaatgatcatcaccggagcgccggtggagaacctggagtttgaggaggtcaattactggccggagctgtcgacgattatggagtggacgaaaacccatgtgacctccaccttacatatctgctggggagcccaggcggggctgtattaccattatgggattcccaaataccagcgggagaaaaagctctccgggatttacaaccacagggtgttaaaccggaaggttccgctggtgcgcagcatgaacgactatttcctggcccctcattcccgctataccgaggtgaaaaaggcggatatcctgcggcatccggagctggaaatcctggccgaatccgacgaggctggagtatttctggtgatgagtcaggagggaaagcagattttcatccagggccatccggagtacgaccgcatgaccctgaacaacgagtaccacagggacttgaagaagggcctggacccggagctgccctgcaattactacgagaacaacgacccgttctccgtgccgccgctgatgtggcgcaacacggccaatacgttgtatgccaactggctgaatttctatgtatatcaaacgactccctataacctggaggaagaggagtaaaaagtcacgttccccaggtttaatggggccggcggggcaggttcgaaccggcgattgacagctcgggaatcagcagcttctgcgcttcgccgatgcccagttgaaccagatttcggatcgtgaagttgaactcgcttatcaggagcccctccagcgtttccgaaaaacaggcggtattccccgtttcgagggaattcatgagggtgtgaaagcaggacttgctaaggcttatttgaccgctgtcctttttccatatgcttctcagggcgtatccccagaagaactggcggagcagctctccgtagacggtacggatcgcctcgtagggggcgaacagcctcagcagctccagcgcgttgtaggtgaccagctcgtacacctgacgctgctctacggtggacaagtgttcgcggcagctttgccgtccggcggcatccagcgccgacatggtgcgttcggaaacctcccggcaggacagcgtcaggatctgcatgctccgggccatatccagcaggcgtttgcggaccactgggtttgtgaaatcgcaattttcggacgtcttgtgaaaggaaagcacccttgtcccgatccgtttttccgacttgacggctccgattccgtttaacaaggccagcgccctgcggaccgtgctcacggacacattccgctcccgggacagcttgctgagagacggcagcagtgtatgctcgggataatgtcccaggctgatctccgtgagcagatccatggcaagcgtgtagcagatctgggaggccttctcataggaactccacgcaaaggaaatttgccgctggggcacaggcgcggtgatccgctcctcataaaaccggcacaggatcggggacagggattcctggacatcgcagattgacttccgaagggaatcccagtcctttttaaggcaaaaatccagatatctcggcgcgtattcatttacggcaaacgcaccccatggattttggggcgtgcttaaaaagggagcctcatagaacgtgaaaatctgccacaggagccggagcagaagatcattgcccagagaatcgaaggcctgtattataaattgaaatgggttggaggggttcagggtgtgttcgattttttgctgcttggtgcgggcgtagatcgccggaggagcgtttttgagcccggcccactgagcccgtcccaacagcggatgaagggatttgctcatatcgatcagggcgtgtttccgctcggaataaaagcgctggacgttctcctcgatctccgattcgctgtaatcccggaccaccacagaccccacattggtggacagcgtaatgtacccctcctgctgcagccggaggtaggcggaacgcacggtatccagggatacgagaaaatcgcccgcagactgttccatggtgggaagcgtgtggccgcaccggtaggcgccgaattggatgtgggtttttaatacattatatacgatctgacaccgttccatatcatttttcacgtcattttcctcgtttcatgtccttcaatattgtgagcggattttgggggcattacggtctgttcattctcccaaacagtatcataacattattttataatatttgccaagttgattctttgtgatgttcgggtccgaaacggttgtccttttatcatgattttgttatactataataaatatggatatgggtaaggaaatgcggggaataccggaaatggaacgccgcagaacatgaaatcctgaatcagtggggagcgcatatgagaaagaaaaaatgccgctgggtgacatacctggcggcaggattgctggcaggcctgctgggcctgtggaatacagggaccgcgtccgcgcaggttgaggagccgcgcccgttaagggtggctttttcccagatggagggtctcagcgagacggaccagtacggcagacacaaggggctgatcgtggactacctcgatgagatcgccaaatacaccggttgggagtatgaatatatccccgtagagaatgacgatattatctctaattttctggaggggcagtacgatctgatgggcggcacattttattcctccggatttgaggaatactttgcctacccggactacaatacgggaaggagccgcgcggtgcttctgtgccgctgggatgacgaccgcctgttgggatacgacctggccacgctgaacgggaaaaccatcggggtctacgaccgggccggggataaaatccggcatctgaaagagtttttggccagcaacgatctggaatgcaggcttaaatattatacatatgaggatatgcaggacggaagtctgtatgagaagctgcgaagcggcgaagtggacatgctgctgggaaacgatctggagaccggcggcgagtttcgcatggtcgcgtccttccaggcccagccctattatatcgtcaccaccgtggggaacacggaaatcctggaggagctgaacaccgcgctccggtatatcctggagtccacgccaaacttcgcggatcaggtttattacgcaaattttccggatctgaagctggcggacatccagttaaacgacagcgagctgcgctatattgaggagaagggaaccgtcaccgttgcgattcccatggactggcacccgatctactgcaaaggcggggggaaggaactgcatgacggcgtcctcccggatctgctcagggagatcaccgcttttaccggcttacagtttacgtttctctacggggacaactacgcggactgcatccgcatggtacagcagggcgaggcggatattctgggggcctatctgggcgagaatgagcaggcattcggctgcaatctggccctgtcgcagccctatatggatctgaacaatatcgtgatcaagtataagtcggtcagctatccgggggaggggcttacctgcgggattctaaacgggaggatactgccggacagctttcaggccgaggaaatccgcggttatgatacggtgccggaattgctgggggcggtcaatgccggtgaagtggattatatttacggcgtctccgccatgctggagcaggagctgcaaaaccaccggtatctgaacgtaacgccggtgacgcaggagagcgacagcacggatgtggcctttgcagtgctcaggccggttaggccggagctgctcacggttttgaacaaggccatcggcaatattcccacagaagaaaaagcggtgatgctgaaccagagtctggtttccgtcggctacaccagcctgtccctgcaggagctgttctattctaatccgttagcatgcattttgattctatcctgcgcgctgattttcattatgtccgtgatcctgatgagcgtgaggagcaggatgagaaatgccctgttacagagcaggctggaagcggcggaggccaagagcacggccaagagcgttttcctgtcccagatgagccacgagatccgaacgcccatgaacgccatcattggcctgaccgatctgacctgcaaggagcgggatgtgccgccggagattgagaagaagctgaaaaaaatacgcagctcgtcccaatatctgctggctctgatcaacgatatcctggacatgtcccggatcgagaacgggaagatggagatcgaacaaaaggacttttcactgtcccttgtgcttcaggaattgcagagtatgatgagcacacaggcggagcagaaggggctggaatttcaggtggatttttatgtcagccatgactggctggcgggtgatccggtccggctgcgccaggttttgatcaacctgctctccaatgcggtcaagttcacccccgccggaggtaaggtaacgctccgggtgaacgagcaatcctgcggggaggagatggaataccgtttttccgtacaggataccggcgtaggcattccatatgaggatcaggagcgcattttttcttcctttgagcagctgaggccctcgatatcccacagcgcgggaaccgggctgggcctgcccatcagccggaatatcgccagactgatgggcggggacctggaagtgaaaagcgagccgggtaagggatcggagttttatatgacgctgcggttcccgaagggcgcgaatgtgccgccgtcaccagaaccggccgggcaggagaatgtcctggaaggcatgaaggtcctgctggcggaggacaacgacctcaacgccgagatcgcccaggaactattggcgatggcaggcgtcgcggtgtgccgcgcggccaacggacaggaggcggtggaccggttctgcgccggaccgccgggagaatttcaggctgttctcatggacatccgcatgccggtgaaaaatggtcatgaagccgcccgtgagatccgcgccagcggacgcccggacgcaaatgtgcccattatcgccatgaccgccaacacctttaaagaggacgaggaggaggccagggcatcggggatgaacggctttgtgccgaaacccatcgatccggaccgcctgtttacggcactgcgccagcatgcgccccattgaatccaatcaaaaacgcccattccgggagtctcccggtctgggcgtttttgtctggtcagtttctgcggtcctccaccaccaaggtctggatcgtatcgggcgaggtgttccagttgagcacataagccgtgtagatccggcggggatttaagatcaccggcgttgtgaccagcgttgtctccggcctggcggatcttgagacagacagcagatagctgcctgcgttaaaggagctgaagctggccgcgtccttaaatggcacggaattgaaataaacgtttccgatggccgcgttgaccggaccgctgtaataggccaggttgcagacgcggaagcaggcggagttgtagccggagggacaggtggtgtcctcaatcacggtcagatccaggccggtgggggcgttgataatcgccaccgtcgccatgccgccgcccacatacagggatttgcgcagatacgtgtatccgttcgtccctgccaccgtaaagacatggtagccctgggagatctggttgtagcgggtgatctccgggaagcccagccccgagctggccagccggccatcgatccatatggaaaacggattgtaacccgttgccgcatttaacaggcggatggaaccgcggacccactgattgttgctgcagaacaggcaggggacgtagggcggaacgatgggataggacgggggcatgacggagaagtccgggtcaatgggttcgtagggaggcatgacggagaaatccgggtcaatgggttcgtagggaggcgtgacggagaaatccgggtcaatgggttcataggggggcatgaccgagaaatccgggtcaacgggttcataggggggcatgacggaaaaatccggatcaatgttgttgtctgtcggaggcacggaaaaaccaggatcgatctgctcttccgatatctgggcagcggtcagaggtaaggattcaaattcattcatagtggcagcctcatactgagctctttataaaggatatatgccccggtacaggctgccgtgtagaaaaaaggagttttcccggtattttaagaccgggccgtacgctcgtagtgttttaatttgtaacggtacatctgatgatccgcttcggcgatcagacttggatattcggtgcagtctccccggactacgccgtaactgatggagcggggataccgggctgggccggatttgagctgttcattggcctgttccagggcagccgccagctcctgcccgttcaccccattgcccatcatgacgaactcgtctccgccgtagcggaacagatccatgtttaaccggccgctgatttcagagagaatccgggaaacgtcaatcaggtaagcatcgccctccagatgtccaaactggtcgttggtggcctttaggccgtttacatccataaacgacagggtgatgcagctgccgtagccggcgtactcttccaggcgcttctcaaagagctggcggttgttcaggccggtcagcatatcggtgtaggccagtttccagagcttgttgatgtcctgtttttccagaatcagacggctgcggatttcgtgctgcttctccatgtagtagtggagggaggcgacgcggagagagtagatgattgtgatcaccaggacaaagatggaaaaaacagcggatttgattccccatgttttgattcccatctcgttgccggactgggagtaggcgaggagctgaatcatcagaaacagatagatgaagacctcggtccaggtgtagaacacaaggcttttccggtagcgcatcatccgctccagccgggaggaaaagtggctgcgccgcaggccgtacataagaaacaccattgccgtaaatccgagaaaaatcggaaatgattttatggaggacagcgcgttgtcaaaggtactgatcggtatattcagcaggatcgagacaaggctgcggaagaacacgttgaccgccaggcccataatcgcgcaaaacagcgccaggccataggacacaaggagatcgaaggaaaatgcaaggcggacttccaggcccagaagaattagaaaaataaaccagttgaccaccagaggaagctccaggcagctggcaatgaaaaaccacaggtacacgaaaaagaagcaggcgaaatgaagccggccggatatgggtttcctgcggatttcagcagagaatttgaaaaattcgcggctgaaaaagtagtaggataccacggttatcaaaacttgaatcagactatttccgtccatgggctgccacgctgctttctatttttatctgcgtacattcgctgatccgccgtttccatatagcggtcgaccgattcttcgttggaggagattccatagctgaagaatatcttgtctttggggtcggccgtttccaaaagctttcgctggagattctgaaccagagcttcaatccggctgatttccccgtccgggaataccagcagaaactcatcgccgccgatcctcgccagatagccgtccccctgcatcatgctggcgcaggtgtcggcaaaacgcttcagcatcagatccccataggtatgtccatactgatcgttcgtgtgcttcaggccgtccaggtcaatgaagacgcagattaaccggaggccgtttcggatgtgctctgccatgatggagcagatttcgcgccggttgtacgcgtttgtgagggaatcaacttcgctcatttttttcagagactctttttcaaaatactgctgggcgatcaggacctgactctcttcatactgacgccgtatttcctcgctttttgcaaatacaaagttgtaattcaggaaattgaatatcaaaaaaaagatcaggacgtctccgctgaccagaagcaggtaggagatccgtccggccggataaagggtcaggatcatggaatccagaatgtggtaggcggagcagacaaagagaaaatgggtatagatcacaactttggatttgtcgtagctacgtttccacaaaaaatcaggatggaaatgaagcaggagtacgcacgttacattgaagaacgcgaacgtcgtgttcatgacgattccacgcagcgttggactggaagccatgcggcccatgtcaaatcccagaagcccgccggttccgatgacagtcatcagcagggaggtgtagatcagataaataaccatggtgaaatgatacatcatcagacgttggtccgggtaaggcagagcgttgagtaacagcagaagcagcaggccgatcagcaaaagcggcagcggaacggccagtaaggctccgcaaaagatccatgcaatacggaggaccgcgaacacggcgtgataccccctgtttttttgattcaggacacccatggcggccatcatccggttcagtagatattccgataatccatttatgaacaaaagtgccggatataaaaccatggatgccgcctccttctcaatgctatcactttaatattctatcatgatttcagacaaaggacaacgctatttgccgcgtctgccgggcggggatagatgtaaaaggttgggaaaacatttggcaaagcttgtaaaatcaaggggggtcaggtataattaagatcggacaccaaccaaaaatggcaagaatggaaagcgggggaccgggtgatcatgaaaaatttaaaagtggcaaagaagctgttcatctcatatgcgctgatcttcgtgctgctgatagcggggtatattgtgagtatcgccgatctgatggggatgggccggcagatcgagaccttttacggagggccgtttatcgtaaacaacagcgcgggtatcgtcaatgcgaattttgaacagatgcagaagtctgtttacagggcgatttgtaattccgatccggagattgtggcggaggccatcgccaaggcgaaggagtctgcccttatcatagagaaacagctgccggtgatccgggagcattttctgggcgaccagcagattgtggaccgtctggacgccgctttcacgaaactgaagcccatgagggagcatgtgctggtcctggcctccgagaaccggaacgccgaggcggccgattatatggagaagaacaatattctggtcatcaaagaggcgcagatggagttaaacagccttcaggagaacggaaacgccatgggggaagctctggttggcggtttgcgggaccagcaggtcggagccattggccggctggtgattctgggcattgtgagtttaacggtcagtctggtctttggtgtctacatcaccagggggatcacgctgccggttcaggagctggagaaggcggcccacgatatcgcccggggagcgttttccgaggtgcagatccgataccggtcggaggacgagctggggagcctggccgggaatatgcgcagcatggcggccacgctgtcggatgtgatcgcggatgaaacccacgtgctgggagagatggcccagggaaattttgcagtgcacgctggccggagagagcgctatgtaggagagctagagcagattctgctttccatgggggagatcaaccggcgtctgagcagaacgatgcttcagattaaccagtccgccgacgaggtggcggccggttctgaacaggtatccgtgggagcccagtccatggcgcagggagccaccgaacaggcggcctccatcgaggagctctccggaaccatcaatgagatttccggccaggtataccggaatgcccagagcgcccagatggccggcgagaaaacgcagagtgtaaaagcgagcgcggatgctagcggccggtgcatgagcgagatgctgaccgcgatgggggatatcagcaagagctccggcgaaatccggaaaatcatcaagagcatcgaggacatcgcgctgcagaccaacattctttcgctgaacgccgcagtggaagccgcccgggcgggagcgggaggcaaggggttcaccgtagttgccaatgagatccgcagcctggccaacaagtctgcagccgcatccaaggatacggcggtattgatcgagggctccctgaaagcggttgagaagggaacgcggacggctcaccagacagccaaggcgctttcggaggtggtggacggcatcgaccacgtggcggagcttctggatcacatcacggaggcgtccctgaaacagtcggatgcaatccggcagatcacggagagcgtggaaatgatttccggcgtaatccagacgaattccgccaccgcggaggagagcgccggctccagcgaggagctgtcctcccaggcgcagctgctcaatcagctggtaaaccgctttaaattgctgcaggaggcataataagagcggccaggcggctgaaaaccggaaagatttggggaagaatgaatgggcgatacaaaggtttgggagggagaacggatccgggcgaacaagcggtggaatgtgactgcagtgctgttgtgcctgtgttttgtgcttggcagcatcctgtttctcaccaatatgggacggcaatacacaaaagaaaatttggtgcttttggacaatgcggcgttccagcatgagacggcgctggtcaagcaggtggaaggcgatttccaaaccctgcacggcgttgcggtttttgcgggccggcaggatatcctggacccggaacagctgatccgcctggttggggaagtaaatgagggaaatgcgtttatccgcatgggtctggccagcctcacgggggagctggagctgatggagctggggggaaaacggtatccgggagtcgatatatcggaggaggaattttttcgtcaggccctggccgggcgggatatgatctccgagccggtgccggatccctaccgcgacggagaatatatcaattactatgccgtgccggtccggaatggggaggaggccattgtgggcgtgctctgcgcggtgaacggcgcggatgtggtgcgcgcgattatcgaagcgccactgttaaacgattcggggtacaccaatttgtacagcagccggggaaagctgattcttagctcagggaccgctttggcggacggcggacagccgcaggaactggccgggctggcaggtttgagcgagaaggagcgggccgccgtagaggaagcgctggagcagaattccagcgtccatttcaactataaggccgggaacaccgggatgctggcggtgttggagccgtcgggggtggaggattggtttgtgctctgttccattcccgtggccgccctgaaccagcggtatgtggtaacctcggcgggcgcaatgctgatcatcgtggcggcatgcagcctgttttcgctgctgctttggcggcagcgccggatgatgaaccggaatcaggcggtggtcgagcggctggcctacgaggacagcctgaccggcgggaggaactacaatcagttcctgatggaggcggagcttgtcaggaggcaggacggccggatggcggtctggtattgcgacctgaaaaagtttaaatactacaatgacgccctgggttatgcggcgggggatgatatgctgcgccggatgtaccgactgtttgagcgtttggagcagccggacgggctgttctgccggctgatggcggataacttcgtgggactgcggtggtatgcggagcgggaggaattgactgagtggttcagccgggtggtgagggagtttcaccaggaggagagcgagacggccagccgctcctatatcgagctgtgtatgggattttactgtcccgatccgtcggattcggggcttacggtgaacgagatggtcaaccgggccaacatggcgcagaagtccattaaaggggagtccggcagccgctgcgctttttttaatgaaaccttaaggcagcgcttccagcaggaggcagcgatggaggcccagggacagcaggcgttggccgaaggccagttccagccctatttccagcctaaattcgacattcagcacggcgaccgtctggcgggcgcagaggtgctctgccgctggatccatccccaaaagggtatgattccgccggaccagtttatcccggtatttgagaagagcgggctcattatgcagctggaccgttatatgtttgagcaggcgtgcagctggtaccgccggtatctggacgggggcggagcgcggatcaatctggcggtcaacgtctcccgcgccggacttttgcgggaggactttgtggattactacgtccgggttaaggaaacgtacgggatcccggacggcgcgatggagctggaggtcacggagagcctggctctgggcggagaggagctgctctgccagctggtccgtgaattgcaggcgcacggattcacctgctccctggacgactttggttccggatattcttccctgaatctgttaaagaatcttccgatccgggtgttgaaactggacatcctgtttttccagcggagcgtggacaaggttcgcgagcggatcgtggtgcgcaatatcatcaatatggcgcgggaattgaagatccgggtgatcgccgagggcgtggaggaaacggagagcgtggaatttctgcgcggggcgggctgcgacatcgtgcaggggtatgtatttgccaggcccatgcctctggcggaatttgaagcgctgttggccggatcggccggtaaatgactgtgaggacaaagaaaaatgaccagccgggggagctggtcatttttcaaggagaaggtatttcgtttcttatggggtgtagcaaaaactatataatgtattgggggggttacgtctattataatagcatagggtatgaaaaaagtgtgcacaaacttttgaaaatatgaaaatatattttatgcaaaattgcggcccattgcattcaacgaaaacgaccagccgggggagctggtcgtcttcaaggagaaggtatttcgtttcttatggggtgtagcaaaaactatataatgtattggggggttacaccattataatagcacagcggttaaaaaaagtgtgcacaaactttcaaaaaatgggaaaaagtttctatgaaaaatgatgacggattccgaggtccgggctggcagaggccggaaaaatgattaaatttccggggcgttaaggggcagtttaccgcacaccggattgtccggctgggcggggggagcttttgccgggggattttcaaattttatctggcggttttccaaaaaatatggcataatatcatagataagcgttaaatttttgttaatacgcagatgaaaatcaggggatcggaatgtttagaacaaaacgggcggtgcgggagctgctgattctgtttctggtcatgttgtgcgcgattctgctgtccggcgtcctgctggtcctgaaccggtcgtcggagcaaaagcagctgaaacacatgacggagcggaatttttgcgccgcacacatttatgaaaacttgttaggcctggagcatgcccttggagcgggcggctctcaggatgggcgcggggaagcttaccgggagcagagcggaaggctggaacagaatttgcaggatatggcggttttggccgcggacagcgagagtttgatcggatatgtacagcagatcggcgatttccagcgcagacaggaacgcctgtggcgggagacggacggagatcaggccgtgtccgcctcgctggagtttctggaacaacagaagctctgtgcccagaacctgatcgatgaaaatttccgggtgtccagcgaaaaatatctggaagatatgcgggtgatcgaccggcagcggctgaccgtgtggggctgcgtggcggtgatcctgttctcgggcatgatcctcacgttcaaccgcctgcggcagcttatggaggcggttgaggagaacctgcgggcaaccccggagcggtaatccgggaatcggtgaaaggagcggcggtcaatggagaaagtcagaaagcatattatcttttccgggagggttcagggcgtggggtttcggtacacagcctgctatctggccagaccgctgggcctgaccggctgggtgaaaaatttatgggacggcgatgtggagatggaggtccagggcgatcccgcggccatcggacgcctgatccaggggcttgagagcggacatttcatccgcatcgaacacatggaggtggaggagattcctgtgatccgggagagtgaattccgggaaacctgggattcgtaaccgccttgctatttttcctgcgttgtgctaatatctttataatattcgcatcaaaggaaatgttaaggggtagtttatggtcagattgataatcaggatcaagcagatttacgataaattcgccgcggatgagatgacggtctatgcagcccaggcctcgttttttaccatcatcgcggcatttccatttatcatgctgctgctcacggtggtgcagatcgtgcccagcgtcagccagggggagctgatggagtttatactcgccctggtcccggtgggctataagtccgtggccttccgcgtgatcagcgacctgtcgttaaagtcgccggccaccatgatctccgtcaccgccgtcacggctctgtggtcctcgtccagaggcatgatgagcatcgcaaagggcttgaaccgggtgcagggaaaggtggagaagcgctggtacattgtgaagcggctgatctgcgccggatacacgattgtgttcattctggtgtgcgtgctgtccctgggccttctggtgttcggcaccacgattcagaatttcgtgctgcgccagttcccgctgatcgcccgggtgacccagcacatcataagcctgcgcacgctgctggcgctggcgttttttatgttcgtgttcgcagggatttacacctatgtgccggaccggaagctttcgttaaagtcccagctcccgggcgccatgttcaccaccgcgggctggattttgttctcaatggcgttttccctgtattttaagctgtttggcggaagcaacttttcctatatgtacgggagcctgaccgccattgtgctgctcatgctgtggctgtacggctgtatctgcgtgctgtttttcggcgcggagctgaattattacctggaaatcttccggagcgaggaggggaaggggctgtgatgggaagctgcgcctcagcccgcgctttcgccgtgctccggcacctgaaacgactggaagaaatgctggcctaccgcggagaggccggcatttttcagtttcaccagggcgatggtgctggtgaggggcggggagcttatgatcttggcggtcagagggaagggggtggactgcccgccgtttacgatggaagccgggaccaccgcaacgcccaccccggaggcggcccacatcaggctggtccgcgcgtcgtcgttgacgcagaggtattcgggctggggatgggggaacatccggccgagcacggattcccagcggcggtagatgatcaggggcagagccgccaggtcctttaagggaagcttcggcccgcagtccgccgggaagaagtccgccctgcccacggccagcatgggctcctccgtcagataacggcagtcgaaggactcttcgggaaacggagtgcgcaccagagcggcgtcgatctgcccggtggtcaacttgtcaaggagctgataggtgtttccctcgctgatgcgaaaggacatcccgggataacgccgccggaacgaggcaatactggtaatgattccctgggtctccacggaggagatcatccccaggcgcagcgtgcccaacagcccttcctccagctgcttaagctcctttctggcggcctttgtcatctccaggatgctgacggcccggttgtagaacaggcggcccgcctcggtcagctggatggcgcgggaaccccggtcgaagagcgtgacgcccagctcctcctccagctggcgcatctgggcgctcagagggggttgggagatatggagcgagcgggccgcgccggaaatgctgccctcgcccacaatggcggtgaaatattccatctgctttaaattcatggcacctcctatatgaagtccgtatggtatctatactaaacaaatattttaaatatggtttttcctatgctataataccagacagagcgctaaaatacaatgatcttcagaaatccggaggatataatgaaacgtttgctgagttacatgaaacattacaagaaagagagcattctggggccgctgttcaagatgctggaggccagcttcgagctgtttgtgcccctggtggtggcgcgcatggtggacgtgggcatccacaaccgggatgtgggctatgtgatcagaatggggggcctgctggtgctgttaggcatcatcggtctggcctgttccctgaccgcccagtatttcgccgccaaggcttccgtgggcgcggccaccagcctgcgaaacgacctgttcgcccacatcggctctctgtcctacgccgagatcgacacggtggggacctccacgctgatcacccgtatgaccagcgacatcaaccaggtgcagaacggggtgaacatgaccctgcgcctgctgctgcggtctccctttgtggtgttcggcgccatgctcatggcatttaccgtggacgtgcggacagccatggtgtttgcggtgacgattccggtgctctgcatcgtggtgttcggaattctgctcgtcagtatgccgttgtacaaaaaggtgcagcgccagctggaccgggtgctattgaccacccgggagaatctgctgggcgtgcgggtgatccgtgccttcaaccggcagaagaacgagaccgcagcctttgaggaggagaacagcctgctggtaaaaatccaggtgttcgtgggcaagatatcggcgcttctcaatcccgtgacctatgtgatcatcaacctggccattgtggccgtggtctggaccggcggcctccaggtggacgccggggttatctcccagggtaaggtgatcgccctggtcaactatatgtcccagattctggcggagctgatcaagatggccaacctgatcatcctgatctccaaggccatggcctgcatgaaccgggtggacagcgtgttccgggtgaagagcagcattgaggacggaagcttcgccgggggcagcgcgtcgccggccgccgcgccatcccgggttcccatggtggaattcgaccacatggacttcgtgtacgccggggccaaggagcctgcgctggaggacatcaccttccgggcggagccgggcgagaccatcggaattatcggcggtaccggctccggcaaatccacgctggtgaacatgatcccgcggttctacgaggccacccggggcagggtggcggtgaacggccgggacgtgcgggaatacacccagaacggcctgcgctcccgcatcggcgtggtgccccagcgggccgtgctctttaagggcaccctgcgggacaacatgcgctggggcagggcggacgcctccgacgaggacatttaccgggccctggatatcgcccaggcccgggagtttgtggaccagaagggcgatgggctggagctgtttatcagccaagagggcaagaacctctccggcggccagcgtcagcgtttgaccatcgccagagctctggtgcgcaagccggatatcctgatcctggacgacagcgcctcggccctggactttgccacggatgccagactgcggtcggccatccgccggggcacgggtagcatgaccgtgttcatcgtgtcccagcgcgccgcctccatcaagcaggcggaccgcatcctggtgctggacgacgggcgcatcgcaggccagggaacccaccgggagctgctgcgggattgcagcgtgtaccgggagatctgtctctcacagctgtcgaaagaggaggtggaacgggatgagcagtaatcaggagacaaacaagagcgcaaaaacgctgcgccggattttgacctatatccgggaataccgcctgtgggtggcattttccctgaccatggccgtggccaccgtggccctgacgctgtatgtgcccattctgaccggacgggcggtggaccgcatagtcgggcagggaaatgtggactttgggggactgcttcggattctgagggtgatcctcatcgcggtggccttcacctcggtgttccagtggctgatgaaccacatcaacaacaagatcacctaccgggtggtgaaggatgttcggacccgggcattcaaccagctggaggtactgcccctgcgctatatcgattcccactcctcgggggatctgatcagccgcatcattgcggatatcgaccagttctcggaagggctgctcatgggcttcacccagctgttcaccggcgtgctgacgattttggggacgctgctgttcatgctctccatcaacccctggatcaccatcgtggtggtggccctgacgccggtatccctgttcgtggccagctttatcgccaaacgcacctacatcatgttcaaacaccagtcggagaccaggggcgagctgaccggtctgaccgacgagatgctggggaatatgaaggtggttcaggccttcggttatcaggaccgggcccagaaaacctttgaggagatcaacagccgcctggcgggctacagcatgcaggccacatttttctcctccatcaccaacccggccacacggttcgtcaacagcatggtctacgcggcggtgggaatcgccggttcctacggcgcgatccggggaatcctcaccgtaggacagctgaccagctttttaagctacgccaaccagtacaccaagccctttaacgagatttccggcgtagtgacggagctgcagaacgcgctggcctccgcggcccgggtattcgagctgatcgatcaggaacccttcccggaggagccaaaggatgcggtgaagctgcagaacgttgcggggcaggtggatttaaaacaggtgaatttctcctatgatccgtcggtgaagctgatcgaggacttaaacctctcggtgaagcccggccagcggatcgccatcgtgggccccaccggctgcggcaagaccacggtgatcaatctgctcatgcggttctacgatgtggacagcggttccattcaggtggacggacacgacgtgcggaacgtgacgcgcaagagcctgcgcaccaactttggcatggtgctccaggagacctggctgaagtccggcaccatccgggagaacatcgcttacgggaagccgtatgccacggaggaggagatcgttcaggcggccagggaggcccatgcccacagctttatcaagcgtatgccgcagggctacaacacggtgatcggcgaggacggcggcaacctttcccagggacagaagcagctgctgtgcatcgcccgggtgatgctctgtctgccgcccatgctgatcctggacgaggccacctcctccattgacacccgcacggagatccgcatccagaaggcgttttcccgcatgatggaggggcgcaccagctttatcgtggcccaccgcctttccacgatccgggaggcggaccgaattctggtgatgagggccggacggattgtggagcagggaacgcatggggatctgctggagaaaaacggcttttacgcagaaatttacaacagtcagtttgcgcgggagtagggcgcagatgggggtgaccggattttgggagcgtttgggaagccggatttgggatttggaaattgatggattctctgtttgcaaaaagaggttgtatcacttataatggtagcagcgggcccggcgtttcccgggcccatttttttggaatcaaacggagtggggaggcggatctgcggcatagcgcggaccgcttcgcatgcccttaagcgggcgggagatgaaaggaacatgcaggaactggacagagcctttttgttggctgcgttggacgggttgaacacgaatatctgtattacggatacggtcacaaaccgcatcgtgtatgcaaacgagaacatgaagcgcatcttcgggctggcggagccggaggggcgcatttgctgggaggtgctgcaggacggcatggacggcctctgccccttctgccggattcgccggcttcaggccatgggcggggaacagagctgcgtgtgggatgagatgaataccctcaccggccggacgtacaagaatttcgactgtctgatccggtgggagggacgggattactatgtccagaattccatcgatgtgacggaataccgcaagctcaccgaggaggccgggctggatgagctgacccagatgatgaaccgccgcgccggaaaagccatgatggagacggcccttaaggccgcccgggaggggaaacggcagatggcggtggtgctgctggatatcaatgaactgaagcggatcaacgacctgtacggccacagcgagggggaccggctgctgcagtacgtctcggccgtgctgcagccccgcctgcggacgggcgacctgatgttccggctcagcggggacgagttcgtgctgattctctccggtgaggacaaaaacagcgccgtccggaggatcgttcaggcgcagaaggccatggcggaccagcgggagcagaacggcatattttacgaggcctccttcagttttggggtggcggaggcctatccggagaaccgcttcacggtggatgagctgatcagccaggcggaccgcatcatgtacctgaacaagcgggattaccacatccgcagggccagggagcgcctgcaggaaaacggcagcaggtccggggatccggggcagttcgaatacgacaaggaccatttgttcgacgctctcagcgcaggtacggacgattatctatttatcggcaacctgaagaacggcagcttccgctattcgccccacatggtggaagagttcgggctgcccggggaggtggtggagaatgccgccgccttctggggcagcatcatccacccggacgacgagctgtacttcctggagagcaaccaggagatcgccgacggccgtgaggagtatcacaacatcgagtaccgggccagaaacgtgcgggggtcctggatctggttgcgctgccggggtaggatgacgcgggatgagaacggcgagccggaaatgttcgcaggtatgatcaccaacctgggcaagcacaaccagatcgaccacatgaccgggctctacaaccggtttgagtttgagggcaacatcaaaaagtacatgatggacgagcgggtagagagcctgggaatcatgattctggacatggacgctttcaagaatatcaacgatctctacgaccggtccttcggcgacgaggtgctgcgcctgaccggccggaagatcgccgccgtgctgcctgaaaacgccgggatctaccggctggacggcgatgagttcgggatcattgtattgggaggggacgaggagcagtgctcggacctgtacaaccgcatccagtaccagttcacgcggcagcaggagtacggcggacggaagtttttctgcaccgtgagcgcagggctggccttctatcccaaggatgcggacaattatctggagctgatcaagtatgccaactattctctggaacacagcaagatgctgggcaagaaccggtccaccgtgttttccaggagcattttgtgggaaaaggagcgccgcctgaagatggcggagcttttgcgggagagcatcgaccaaggctttgttggattttccgtctgctaccagccccaggtgcgggccggttccggccgcctctacggggcggaggcgctggcgcgctggcattgctccgagttcggcgacgtctcgccggtggagtttattccgattctggagcagaccgggttgatcggccgcctggacgagtgggtgtttcgcagcgccgcccgccagtgcagcctctggcgcaggtttgccccggattttatggtcagcgtgaatttgtcctatgtggagcttatggagcgggatgttttccccgccgtcatgggcgcgctggaggagttcggtctgcctccggccaatgtgaccctggagctgacggagagctgtatggtgaaggaggacaaacaggtcaacaaaatcatggggcggttccgtgaggcggggctgaaggtcgccatggatgatttcggcaccggctattcctccctgaattccctgaaaaatattcccgcggacgtggtgaagatcgaccgcagctttgtgacgggaatcacggaggaggggtacaacgccaccctcatccgctcggtggcccagctctgccgtcaggtggatatgcgcgtctgcgtggagggggtggagaccgaggaggagcacagcgcggtgagggggatgggcgtggagctgatacagggttactatttcggccggcctatgcttccggaactgtttgaacagaagtttacggggatgtgagacaggaggaacggccatggatttttatcagcgggtagggattgtctgccgggcgattccggcgggaaaggtagccacctacggacagattgccctgctgtgcgggaagccgcgcaacgcccgccaggtgggctatgccctgaaccgtggaagggcgggagcggatgtgccggccttccgggtggtcaacgggcagggggtgctcagcggcgcccaggcattttccaggcccaatacccagaaaaagctgctggccggggacggcataagggtgtctgcggacaaccgggtggacttaaagcggttcggctggcacaacaccctggacgaggccctgtttctgcggcaggagtttgagcggctgggtatataacgagtgaaacgggaggacaggaagatgagaaatggtacaggaaatgcaggtgtgggcagccggcttctggcgctggccgtagcagcagccctgatgctgtccggctgcggcggcgcatccaaagcggacgggaagccggaggcgtttatgcggcgggagagtctggccctgacggagcagatcggcgctctggcggccaacggggaatatgtgaagctgatgacggtttccggcgaactgctggaggagacggaggcggtgggcgctcaggacttcacgcagcccacggctgtataccggattgcggtcacggacgatatgctgaagaaagttgtgtcgggagccgggatggagccccttggagaggaaaccatggccgctctcaggtccaggctgaacgccgcctttttcgccaacctggtaaacggcagccagggcgctgcggtgctggccgccatgaatgtgctgagctgcggaaagtcctaccgggagcccgggaactggccgggcgactccctggtgatcctggagtacgggaacggctataccagcatggtcacctttatgcagaccggagagggcgtgatcagcgcggaggcctcgctggctaaggacggggagggagacgccacggccttgctgctccagcttttgggggtgggggatgaggagttggagccgtttggtaccccttaggacaaggccctattcgccggcaggcggactgtgacttcggtgccggtgccgggatggctgttgaaggacaggccgtattggatgccatacaggcttttgagccgcagattcgtgttgtagacgccgatgtggcccgtttcggttccggacgccgggggatttgttcccccggctttttttgcgccctcctgcagggaatccagcttttccgggggaatcccggcgccgtcgtcggagacgataaagacgatgtcatctccctcccgccagccggtgatcaggatgctgccggtctttttctccgtcatgcggatgccgtggagcagagcgttttccaccaggggctggaaggtcagcttggggatggtgtagccgcagagctcctccggaacatcgatcacaagggtggcgcagttctcgtagcgcatgttctgcagctgcacgtacaggctcacgtgctccagctcgccgccgatggtgttcatcagttccctgcggcttaaggtcagcttgtagaagcgggagagggcctggacggcccgggttacctcctccttgcgcccggtctgggacagccagttgatcatgtccagggtgttgtagagaaaatgggggttgatctgggcctgcaatgccctgaattcggctttgcgcagatcctcagccgcctgttccctggcatccatcagccggttgatctctccggtcatgtaattgtaggtgtcggatagcactccgatctcatcgcaccccaggccgaccttcatgggtttgggacggccggtgcgcacgctctccatctggtaggccaccgcgatgatccggttggcgatggaggaggagagcagcagcgcgataaacatggctaagagcacgaacagcaggtagatcaggataaactggatcatcagcagccgtccggcgtccgtgatgtggctggcgggcagaatggagaccatgtaccagccggtgtcatggatgggaaaataggcgctgtaagcggctccaccctgaaaattcaccagagaaaaggtctggcctgcgcccaggcggttggacagctggggaaagggaaggaaataccgcccgtccactgccggggacattccggccaccgggatatcctggctgctcacaatgtaggtggacgcatcctggaccgaggtatttcccgccagcacgccctccaggatatccggtgaaaagtagacggccacataggcggaggcctggggaggcacggtcacgttggacccggtccggctgtaggaaaggcggaggatggaggcaaggccgccgcattccccgatctccgattcggagagcagctcgccgggacagagcatgagctcctcggagctggactcaaactgtccgatccatgggctgtccaggccggagacgggcagaaacaggggatggcggccctggttgtaccggcttaagtcctcataggacgcgtcgtcatagtagatgcggatatccgtgataaaggagtggtccacaaggttggaggccaggcggtacaggctgtccaccctgctgcgctggggctggtgggttccggcctgttccaggggcacgttgaacaaatccagcaccaggccggtgcgggccatcacctccccggcgtggacggcgttgtccaccaggctctcgatggtgcccacggtctgggtggccagggcctgctcggagcggatggtgtcgtccatgacgatgccgtacatgcgggcgtagagaaaacccgtcaccaccgcggtggggaccatgagcaggatggcgtgggagatgaccagcttgttcttcaatttgagattgtaagtataatgatgcagcagccgtgcaaatgggttcttcatgagagcattttctccctgtattcggacggggacaggccgacaattttccggaaggtcttgctgtagtaattgccgtcgctgtagcccaccttggaggagatgtcggcgatcttatagcgggggtccgccagcagccgcttggacatcttgatccggtagtcggtcaggtactggtttaaggtcaggccggtttcatttttaaagagcgtgcacacgtagctggaggacagatggacgtgctcgctcacatccggcacggacagtgtggggagggaataattctggtggagaaattccttgatctgaaagaccacgggattctccccgatgccctggctcagctgttcaaagtacaggtggattttcccttccagaagccggccaagctggggcagggtgatgcattccatgacgctgtcccagatggagccggagttcacttcgtcccggaaccacagggaaatgtgattggacagggcgtactcgtccagctttcccaggtatttatagtagagatcccgcacctggctgggcatgagggagacgccggacccggcgctgcggtagagctgtccggccacctccagcaccttagccttctgctgttcggacagcgccacgctgaattccgtcagcatgtccttgagcggcagaggggattggggctccgtgtggggagacaagaccgtgtctacctcgtagaaaaagctgcgttccagaagctcccaggccttccggcccgacaggcaggctcgctcggctccgcagaccaccggccctctggcgatgaagaaatggcagactccggaaaaaccgccggccagaagccgggtgcagctctccaacaccggttcctcggggcggctgtccccgtagagctggatgataatatagcggtccgcccggaaggtgtagagctgggacaggccgtgggcggtcagatgcgccaaaaagcgggcctgaagttcgtccatgaccgtttccggcagcacggagaggggcgtcaggcagtccaccagcagggtggtaaagcaggtgccggggccgaagggcaggttcaggctgtggatcagccggtccatggcccccgggccgccgcgctcggggtctaaaagcagctgcgccagctgtccctgctgctccttggtgcaaagcagggccgcgctgcggctgctggagcgggccagacggctgcccgccgcctccttaagcgccgccgccagctcctgtatgtccagaggcttttccacatagctgacggccttcagcttgatggccgccttcagatactctttgtcggagtaggcgctcataaagaccagggatgtgtccggaagctgctctaaaagcttttccgccatctccacgccgttcatccgcggcatgcgcacgtccgtgagcacgatgtccggttcctcccgaagcgccgcctccagaccgttgacaccgtcgtccgccaggatcacgctgtcgatggagagcgcctccaggtccaggctccggcgtatcccctccctggtcagcttttcgtcgtccacaatcaaaagtttcatggcaacctgtcctttccgttaaaatcatattaaccattttaccaagaaatcagaataatgcaacgtgattcgcaggtccgggggagcaaaaggataatatattacagcatttaaaaaaatattaccatggattccctgtgcggtaaatgttaagataatatcagcgaagagaagaacaagaaaacgagcccccggcagccgggcggtgaaacttagatttaagataccgacaggaggaaattgaacatgaaacgtatccttgtaaagttcgatgaagcagaccagattattaattttgtgagaattatcaaccagtacgaatacgacgcggatgtgaagtgcggcagccggattgtggacgccaagtccattgtaggcgtgctctccctggcccgttccaaggacctggagctgattctgcacaccgacgagtgcggcgatctgctggatgagatcgcgcccttcgctgcgtgatgaaaacggagtgcgactgaaagagaagacggaaaatgccgtctgcaaggctgatatgaggcccggcagacggtattttggcgttgacggggagcggatgggtatgaaacgggttaaagaatttataaagcgggagacagtgctgacggcggcgtttttgctggcggcgctgtccatggtgtttgtcagtccggaccgggcgtacggcgggtatgtggattatcagaccatcgcccttttgttctgcctgatggctgtgatggccggattccagaaactgggaatattttcctatattggccgggagcttctgggccgcgtgcgcaccgggcggcaggccgcggccgtgttggtggggctctgctttttttccagcatggtcatcaccaacgacgtggcgctgatcacctttgtgcccttcgccctgaccgtgctgaggatggcggggctttcggggctgattctgccggtggttgcgcttcagaccatcgcggccaacctgggcagcatgctgacgcccatcgggaatccccagaatctgtatctgtacgggaaatcaggtctgggagcgggagcgtttatccgtttgatgctgccgtactgcgcgctgtctctggggcttctgggcctcagccttctgtttgtggacaacggaagggtccggaaggagcgggcgggtcaggaggcggaggggaaaatctgccgggggaaggcgggcatgtatctggttctgtttgcggcctgcgcggccgcggtagcccggcttctgccctggcaggcggttttaaccgcagtgattctggcgctgcttgtggcggaccgcagcgtatttctggctgtggattactccctgctgctgacctttgtgggctttttcatctttatcggcaatatgggacgcctgccggcgtttaaggaattcctggacggaatcctctttggccgggaggcgcttaccgcggtggcggccagccaggtgattagcaacgtgcccgcggcgctgctgctgtccggcttcacggaccggtgggagagcctgattgttggcgccaacttaggcggtctgggcacgctgatcgcctccatggccagcctgatctcctacaagagcatcgccaggcattacccggagcgaaagggcagatacctggcgctgtttacggcggccaaccttgtatttcttgctgtgcttctggcgtttcaccggtggatgcaggggccgggagccggggcgtgaaaacaggccggcagtccgatggggactgccggcctgcggcattttaagggtgaactttaaagttcccgggtcaaccgagaatcgcgtcctttttggcgagaatggcctcgcaggcggcgcatgccgggcagtcgcagtacctggcgcccgcagccttgatctctctggcgtgtgcggccacttctttggccttgtccgccccgaatacctgggctcccgcctcggaatccgcgaaaccgatcagaccgtcgatgggcatgatgtccgcttccagctcgccgatgtatgtctcagtggcagctgcctgccgctctgtgccgactgcggccagccaggcctcggcggaagctctcgtctcgctgttgcaggtcggagaatcgatcaattcgtgagttttctctactacaaaatccaaaacgtctttctgcatatatatgaccctctctttcttctgaaatcacctatatcttaccataattgtcaggcatttgcaatttaaagttgtccgccgttccggggccttgtagccctccacgccgcatgttaaaatagaatggaaccgatgtgaatggatccgaaaatgggaaaggagctgattggatgacggtgattggaggaattatggttccccatccgcccctgatcgtgcctcaggtgggcagaggggaggagcgggcggtggcggccaccggggaggcgtttgcccgggcggctgaggaactggcgcagtgggggccggagaccattgtgctcgcttcgccccacgcggtgatgtacggtgattattttcacgtgtcgccgggtaagggggcgtccggcgacttccggcagttcggcgtccgggatgtttcgatggaggtgtcctatgaccgggagtttgtggaaagactctgcgatctggcggacggggaggatttcccgctgggcaccctgggcgatacgggcggaggactggatcacggcactttggtgcccctctattttatccggaagtaccggaaggacgtccggctggtgcgtttggggctgtcgggactttcgctgtcggaccattaccgggccgggcagctggtagcccgggccgccggacagcttggaaggcgagtggcctttgtggccagcggggatctgtcccacaagctgacggaggacgggccctacggctttgcgcctcaggggccggagtacgaccggcggattatggaggtgatgggacaggcgcggttcggggagctgttcggctttggggagagcttctgcgacaaggctgcggagtgcggccaccggtcctttgtgatgatggcgggggcatttgaccgcagggcggtggaggcccgggccctgtcccacgaggggcccttcggcgtgggatacggagtctgcgtgttccgggatgccggtcccgacgattcaaggaattttctggagcagtatgaggacgggcagcgggaggcctgcgcccggattcgggacggggaggatccctacgccggactggcgcgccgcagcctggaacattatgtgcgttttggccgcaggctgcccctgccaaaggatctcccggaggagatgacggaccgcagggcgggagcgtttgtctcgatccacaagcagggcgcgctgcggggctgcatcggcaccatcagcccggtctgcgaaaacgtagcccgggagattctgcaaaatgcggtcagcgccggaaccggagatcccaggtttccggaagtgcgggaggaggagctggatcagctggtctacagcgtggacgtgctggggcaggcaactcctgtggactccctggaccggctggacgtaaagcgttacggggttatcgtctccaagggaggaaggcgtgggattttgctgccggacctggaaggcgtggacacggtggaggaacagatcgccatcgccaggcgcaaggcagggatcggggagcaggagacaggcgtgaagctggaacgttttgaggtggtgcgccacggcggggagggagcgtgaagatgatctgtccgttttgcctgcaccactgcaggcttgaggaggggcagaccggcttgtgccgggcgcggaaaaatgtgggcggccggtcggtggcggtaaactacggccgcctcacggctctggcgctggacccggtggagaaaaagccgctccgccgctttatgcccggttccatgatcctgtctgcgggaagcttcggctgcaatctgcgctgtccgttttgccagaaccacgagatttccatggcggggcgggagtccgcggccgtcgccatgatgccggaggagctggctggccgcgccagcgccttggccgggaacggcaacatcggggtggcgttcacctacaacgagccgttagtgggctgggagtatgtccgggatacggcccgtcttgtccggcgtctgggaatgaaaacggtggttgttaccaacggcagcgtgacggacctggtgctggatgagattctgccggtggcggacgctatgaacatcgacttaaaggggttccgggaatcctattaccgcaagctgggcggggatctggagacggtaaagcattttatcagccgggccgccggggcctgccatgtggagctgaccacgctgatcgtgccgggggagaacgactcggatgaggagatggaggagctggccgcctgggtggcctccctgaacccggaaatccctctgcacgtgacccgttttttcccgcgctggaggatggcggacgcgcggcccacgccggtggacacggtgtaccgcctggcggagcgggcggcagaagcgctgcggtatgtgtatgttgggaactgttgagagcgtgtggtgggccgggccgcgcaggttaggcgcaggcgcggcagcgggaatgcgtgtgggaaaccgggtgggaatccgcgtgggaaatcgggtgggaaaccgcgccgccgcggttggaaaatcgggaaaagtgtggtatagtagacggtaccgccgccgttcgaaacggcggcaggacggatatgcttgaatacgatcaaccgcgggagggtctgcggggattgcacggaggattggatggaacgagaggtaattctgtatatcggcgtcagcgtggacggctacctggcggacgcggacggcggcgtggattggatgaagggccacggcgccgaggagggagacggcggctaccaggcgttttacgagaccgtggacacgctgatcatgggtcgcgccacctacgagcaggtgaagacgcagctttcgccggacagctggccctatgagggcaaggagtgttacgtggtgaccagccagtttctggaggataccgacgaggtgaccttctggcccggggacgtttgggagctggtgtttctgctcaagcagcggtccggcaaggcgatctggctggtgggcggcgcaaagttgctaaagagctttatggagcaggagctggtggaccagtattggatttccacgctgccggtaattctgggcaaaggtatgccgctgtttctgcccggggattacggggagcgcctgatcctggaccggaccctggtgtgggacggcgtcgtgaccaatgtgtactttaaccgggcggagaacgccgaatagacggaggatcgggatgcgctatacaataccatattattaccgggaattttcctgtgcagcggaccgctgcacggacacctgctgcgcgggatgggagatcatgatcgatccggtttccctgagaaagtaccgaaaaaccaaaggtctcctgggcaaccgcctgcacaacagcatccgctgggaccagggctccttcaaacagtacgggcggcgctgcgccttcctggccgacagcgggctgtgcgatctgtactccgacggcgggccggggatgctctgcaaaacctgccggacctacccgcgccacatcgaggagttcgagggggtcagggagatttccctgtgtatctcctgcatcgaggcggcgcggattgtgctgggacggcgggagcccgtgcgtttcctggattttgagcgggagggagaggaggactacggggatttcgatttccttctctataccaagctgacggacgccagggagctggcagtccgaatcttacaggaccggagccatcccctggcggagcgggcgtccatggcgctggctctggcccacgacctgcagagccgcatccgcaaaaaccgcctgtacgcggcggaccagctgttggagcggtacgggagcgccggggcgggggagcggtttgccgggcggaccgccgggtttggagccgggctgaagcagcgttaccggggatttttcagtctgaccgaggagctgggccgtctggaagcgctaaacagcggctggcccggacggctggccgggcttagaaacgccctgtacgggtccggtgaggaggcgtacggccggatctgccgggaatttgccggggatttaatgggcgctgcggacggggactgggacatctggggcgaacagctctgggtgtattttgtgttcacctacttctgcggggcggtttacgacggccgggcctacccgcggatgaagtttgcggcggcctgcgtgctgctcatccgggagctggccatggggacctgggcgctgcagggtgggcagctggactttgacggctttgtggatattgcccaccggttctccagggaggtggaacactccgacgaaaaccgggaggcgctgctggcccttttggagcgcgaggagcgctttggcctggaaacgatgttaagtctgattatttccgaggatttccaaaaacttaagaatctatcgtgaaaatcggagaaaatcagcagtgtattcaaaaaaactttataaaattaatataaaattcagatcaccccttcaaaaagtagaaaattctctctttttatgatataataaaaaaaatttcatacgaaggagtgatactttatgaaggatcaaaatggttttaaaccatttatcccggcgaatcaggttgtaccggagatgactgcggtatcaatcgtgctgggtattatcctggcggtattgttcggtgctgccaacgcctatctgggattgcgcgtgggtatgaccgtgtccgcatccatcccggctgcggttatatccatgggggtgatccgcgtgatattgaagcgcgattccatcctggagaacaacatggtgcagaccatcggctccgccggtgagtccgtggcggcaggcgcgatctttacgctgccggctttatttatgtggatgagcgattggggagtgggagccccgtcgctggttgagatttccctgatcgccctctgcggcggcgtgctgggcgtgctgttcatgattccgctgcgccaggcgctgatcgtcaaggagcacggcgtgctgccctatcccgagggcacggcctgcgccgaggttctggtggccggagagcagggcggttccaaggccggagtggtatttgccggcatgggcatcgcggccgcctacaagttcatcgccgacggcttgaagctgttccccagcgatgtggattatgatatcaaacaatacggcggcggcgcgggaatctccgtactgccggctctggcgggcgtgggatatatctgcggccccaagatttcctcctacatgttttcggggggaatcatttcctggctgatcctgatgcccatcatcaagctgttcggaagcgggctgacccagccctttgcgccggcagaccagctgatcagcgagatgagcagctccgccatgtggggctcctacatccgctacatcggagcgggcgccgtggcggcggcgggcatcatcagcctgatcaagtccctgcccctgatcgtcagaaccttccgtgacgccatgcgcgatctgagggcgggccgtcaggcatccaccctgcgcacggaccaggatctgcccatgaacgtggtgctgcttggcgtgctggcggcctgcgtggtgatctggctggttcctgcggttccggtgaatcttctgggtgcgctgttgatcgcggtgtttggattcctgttcgcaacggtttcctcccgcctggtgggcctggtgggctcctccaacaacccggtgtccggcatggccatcgcgaccctgctggtgtcctctctggtgttaaaatccgtgtccggaaccgggcatgagagcatgatgggcgtgatcgccatcggcggcgtgatctgcgtgatcgcagccattgcgggcgacacctcccaggacctgaaaaccggttacatcgtgggttccacgcccaaaaaacagcagatcggcgagttgatcggcgttgtggcttccgcccttgccatcggcggcgtgctttacctgttgaacaaggcctggggctacggcaccgacgagctcccagcgcctcaggccatgatcatgaagaccgtggtggagggtgtgatgaacggaaacctgccctggaacatgattctctcgggggctgccatcgcggtggtgatcgagattttgggcatcccggtgatgcccgtggcggtggggctgtacttgcccctgcgcaccacctccgccatcatggtgggcggactggtacgccactggtttgagaagcgcaaatgctccgacgaggagcgcggggaggcggtgagccgcggtatcctctatacctcgggtatgatcgcgggcgagggcctggtgggaatcctcctggcggtgttcgccatcattccgtttgcaggtccaagaggcggcttcctggccgacttcctgaatctgtccgccatggaaaacggcctgggcgcgtttctgtccggaccgtccgccaagctggtatccctggcggctttcgcggcgttgattctgatcatgtgtagatttaccatctggtaccgggaagataagaacaataagaaataaaaaccgcggcggttgaagggagaatgaatttgttgggcaagagaaaaagcagcaggaattacctggagcagattccggagcgcaatcctaagcttacctggaaggaagaccagtcggggatcgtgatcctcgacatggtccatcgggggttgtttgacaagatcgcccagggcctgtttgccaccccgaaggtcagtcatatccgcctggaggcgtttggcagctttatctggaagcagatcgacgggcagcgggacctggcggagatcggggcgcttgtaaaggctgagttcggggaccgggccgagccgttgtacgagcgcctggctcagtattttgagacgctggccggcaatcattttatatcatatcgttgagcgtttgagcgcgggcgacggatgcagaagaatccgccgcccgcgctgttttggcgtgttactgggaacggagcgtacagtgacatcagcggagagccgatgccggaggttttcggttgcctattgaagttgcacggtaattttactataatacaagggtaaaacaaaacggcgggatgaatccggagggagaaatgagatgatctgttacagcagccattatcgggcagaacttgtcccggacccgtcctacaccatcggttcggcggacaaccggccctacgaccggatcatcaacccggacgggctgggacggggagattttgcgaaggtatgccgccttgcggtggagcggtttgaaaccggggaggagcggcaggctgcgctgatcggtcccaaaacctggtgtgttgaaagctgcgccgtgctcgaggaatcccgtttgaccgttctgatggaccgcgtggtgatcagactgtcgctcgacaactttgagatcgtttgcagccggagacttgacgtctgcggctccatgctggctctgtacccttgcggaggggatttgatcctgcacggggagctggaggtgctgcgcctgaaccgggagctgcagaccgtctggacattctcaggccgcgatctctttgcgtccctgacaggggagcgcgccttttgcctggagaacgggcggatccgcctcctggactgggaggggaaccgctacgagctgagcctggatggcgagctgctctcggaccgtccggcgccggaaaaacggattcttacgatccctgtggccgacgccgcttcaccccgggagctccagcagatattgaaggagtccctgggtctgccggaatggtacgggatgaactgggatgcgttttgggacgggatcaccggcctgatccgcctgccggacatcctgatcctggagggctggcacgtgtacaaggccagatggccggaggacgcccgcgtgatggagggcctgttggatcgatataaccgggaggcgaaatacgcctgccaggtgatataccgcttttatcggtgaggcacgggggaccggccgccccggaagcggatatacagatgaggaggaagatatgaatcagatcagacttggaaaaacagagatttgcgtgaaccggaacggattcggcgcgctgcccatccagcggattccgaaggaggaggcggtccggctggtccgcaaggcttacgaccacggaatccgtttttttgacaccgcatacacgtacacggacagcgaggagaagctgggggcggccctggccggtatccgggaccaggtgtttatcgcaaccaaaacgcccgccgaaaacagtgcggatttttggaaacatctggaagaaagcttgagaaggctgggcacggactatgtggacctctaccagttccacaacccgtccttctgtccaaagccgggggatggcaccggcctctatgaggccatggaggaggccaaaaaccggggaatggtgcgccatatcgggatcaccaaccaccggctgagcgtggcccgcgaggctgtggacagcgggctttacgagacgctgcagttccccttctcctatctggcgggggagccggatctggagctggtggagcgctgccgcaggcaggatatgggctttatcgccatgaaggctttgtccggcggactgatcaccagcgccagggcagcctacgccttcatggttccctacagccacgtgcttccgatctgggggatccagcgggagcgggaactggacgaatttttggaatgcgatcggcttgtcccggaaatggaccaggagctgaaggcggtgatcgaacacgaccgggcggagctggccggcgagttctgccggggctgcggctactgtatgccctgtcccgccggcattgagatcaacaactgtgccagaatgtccctgatgatccggcgctccccttcggatgcccatctcaccggggaggcccgggagaagatgaaaaagatcgaggactgcctgcactgcggccagtgcagcgcaaaatgtccctacggtctggacaccccggcgctgctggaaaagaactatgaggattaccgggagattctggcgggaaagccgctgtgacaattcttcccaaagcgggagaaacatgagaggagaccggccatgatacgatattacggcgatccgccttaccgggcggctgtgatacacggcggtcccggcgctccgggatcggccgcgggcctggcggccatggcgggtgcggtctgcgggacttcggagcccattcagtccgggaaaaccatccgggagctggttttggaactgaaagagcagctggaggaggcgggaaccgttcccgtcattctggccggacactcttggggagcgtttctggccgcgctctttgccggagcgtacccggagatggtggagaaattggttctggtgggctgtccgcccctgacggccggttacgtccctatgatcggggaacgccgcaggcggaacctgggcgccggagagcgggaggagttcgaccggttaaatctttggttggaacaggggatgccggaggaggcggaccgtctgctggcgcggctgggagagctggcggagctgggcgatagctgggatcctctgccggacacaatggaaaatgatttcccagtggacgcagagcagtacaaggctgtgtggggggaggcggtaaagctgcgggcctccggacagctgttgagaagctttgcggccctggactgcccggtcacattgatccagggagagcaggacccgcaccccgtgtgcggcgtttgcgggccgcttgcaggctccgggaaggagtaccgggttcacgtccttaaatgctgcggccacagtccctggctggagcgccgggcgcgggcggaattcttcgaaattctgaagcaggagctggggcagtgattgtgataccatccggctgccaacacaaaagaggaggagatccatatgtatgaatcgcgttgcggggttcgctgcgacagctgcggtcgcaagggagaagtgaattgtacgggctgcataaacatgaaaacgaccttctggggcggagcgtgcgcggtcaagtcctgctgcgagagccgcagcttaaaccattgcggggaatgtcctgaattcccatgcgcgatgtgcgcgtccatgggggaggagatgggctttgaccccaagcccaggctggaagccttgcggcagtgggccggggaagggaaaaccgaataaaacaaacatacatacaaaacagccgccgcggaagatggcaagtaaaccgcggcggctgtttcgttttccccgggatggcttccgggtatatgttcagaggattccggccgtatggcaagacagccggatttattgataaacagaactatgaggatttatttgttggtcttgtaaaggttcttttccctgggcagcgtcacgttcagcagaatggccaccagggttgcgattacaaccggtgatttgccgaagatggtggttacccatgccgggaaggaacttaaggaggcgcttgcctgtgaaacgcccatgcccagcgcggccgcgaggcctacgatggaggtgttgcggtagttcatttcctccgtcataaccagcttcataccggtcattgcgatggaggcgaacacggatacggtagctccgcccaataccgcgtaggggatggtggtcaaaagcgcggagaatttggggaacaggcccgccaccaggattaccagggcggagattcccagagtcacgcggtttaccaccttagtggtggccacgatacccacgttctggctgtaggtcgcggtgggaaggcagcctaagaaggcgccgattacgttggtaatgccgtatcccaggatcgcgccctgcagctcatccgtggtgggctcgcggtccagacctcccgccgtggtggcggagaagtcgccgatggcctgcacggaattgatcacgaacagcagtccgatggctacgcaggcggagatttcaaagttgattccaaagtgcatgatgtggggcagctggaacattccggcttcgcccacgttggtaaagctgaccattccgaagaacatggagaatatgtatcccgcgatcatgcccatcaggatggaagccagctttaagaagcctttggcaaaatggtttaacacggttacgacaaccagggtgaaaatcgccaccgtccagttctgccaggagccgtaattgggctgtccggtgccgccggccatgtagttgatggcggtggggtagaggctcagtccgatggtgaacaccacggtgcccgcgattaacggcgggaaaaacttgcggatctttttaatcatgatacccacgataaccgcacagataccgcccacgatctgggagcccagaatcgtcgcaataccgtactgttcggcaatggcctgcatgctgggcacataggcaaagctgacgcccaggataacagggaggccggcgcccaggcggagtccgccttttttgcccagcggaaacagctggagcagggtggcaagggccgatacaaccagagaagcctggatcaggattacccggtctgcggtgtcgataccggcagcaccggaaatgatgatggcaggcgtcacgcagcccacaatcatggcgactacgtgctggagcgccaggggaattgcctggctcatttttggaacgccgtccaaatcgaacagtgatgcgtgctgtttttctgaattcatgatattgcctcctttacgctaaatggatatgagtaccggtttttccctggataccgtcttttgctttttccaacagcgtaattaaagcagtgcgtcctggctttgattcagcaaattttacagcggcctgtaccttgggaagcatggagccgggggcgaagtggccctctttgataaacttgcgtgcttcttccgtgtccagatcatccagccatttttcttccggctttccgaagttaacagctaccttttcaactgcggtcagaataattaagaaatctgcgtttaattcttctgccagcagctcgcttgcgaagtccttgtcgattacggcgctggcgccttttaagtggttgccctggcgggtaaccgggattccgccgcctccgcaggcgatgaccagctgaccggagtcaaccagggaacggattgcgccgatctcgacgatctcggcgggtttgggggaggccaccacacggcggtaaccgcgtcctgcgtcctcgcgcatcatatatccgtatttttcctcggcgatcttggcctgttcctcggtcatgaagtggccgatgggcttgctgggactgtcaaatgcgggatcgtccgcgtccacgcggacctgggtgatcatggtcgataccgggatatcgcagatatcgcggttgtacagctcctcccgcagggcgttctgcaggtcatagccgatgtaagcctggctcatggcgacgcagacggagagcggggtattgggctggctggcgtcctcgcggctgagagcggccatggcgttgttgatcatgcccacctgggggccgtttccgtgagctacgataacctcacagccctcctcgatcagatccacgatcgccttggcggtgatcttcacagccttcatctgctcgggcagcgtgttgcccagggcatttccgcccagggcgatgacgatacgttttttcttgttttccatagtaatttcccctttgagtttttgcaaaaaaagatgaaaagggccgccaggccgaatgcccggcagcccggaataaaaatcatttaatgtggattacttgaatacgcggggagttcccttctcttccagcttctttaacacttcagccggatcggcaaacttagccagcatgatcatggcggcgatcacgtagggtttgaagctggcttccttgtacagcggatcgcggtagcggtcgaatacggaagcctcaacctcgccgtccttgcagctcacgtcgttgatgtcggccggtaagcagtgcaggtacagagccttgccgtccttggtggtcttcatcagctcctcagtgcagcaccagtctttgtgctgtgcattctgagccagcagctctttctccagagccttgattccctcggtgtcgccctcgccgtacaggttggttctcttctccatagcggcgaagggagcccagctcttcgggtaaacgatgtcggcatccttgaaggcgtcggccatgtcgtgggatacgcggaaggaaccgccggacttctcagcgttctgttttgcaacttcctcaacctcaggcatgatctcgtagccttccggatgagccaggacaacctccatacccattctggtcatcaggccgacaacgccctggggaacggagaggggtttgccgtaggagggagagtaagcccaggtcatagccagctttttgcccttcaggttctccacgccgccgaactcgtggatgatgtgcagcatgtcagccatacactgggtgggatggtcgatgtcgcactgtaagttcaccagggtgggcttctgctctaagatgccgtccttgtagccctgggaaacagcgtccacaacctcgtgcatgtaggcgttgcccttgccgatgtacatgtcgtcgcggataccgatcacgtcagccatgaaggagatcatgttggcggtctcgcgcacggtctcgccgtgagctacctgggatttgccctcgtccagatcctgaacctcaaggcctaacaggttgcaggcggaagcgaaggagaaacgggtgcgggtggagttgtcgcggaataaggagatgcccagtccgctctcgaacaccttggtggagatgttgttctcacgcatgaagcgcagagcgtcggctacggtccaaacggcctccagctcgtcgtcggatttctcccaggtcaggaagaagtcgccctcgtacatttccttgaagttgagtttgttcagcttatcgatgtaatcctgtaatgttttcatgattttaactcctttaaaattgtatgttaatttttatgggtaacgtgatattgatacggaaaaccggctccgtccggatgttccggcggccaattcagcacaaaaccgccggatatcgtctgagacggtgcgctgaaagaaaattggcaagagctttcagcgcggcattctaggagtcggatttcgggaaaatgtcaaattacttgcagtaaacggtgggcagagcggcgtaaacggcagcgcaggtcaccagatcctgtttccaggtcttctcgttgggagcgtgagcctgagcctcggcgcccggtccaaagccgatgcaggggatgccgttgcggcccatgatggatacgccgttggtggagaaggtccacttgtcggtcagcggacgggcggttctcatctccagagtctcctctgcgccgatgcgggcctcgccgaacaggttcttgtaggactcctccagcgccttggtcacatcgtgatcctccgggatcacccaggtggggaagtagcactctatggggtatgtaaggcccttgtaggaaggacgggaatactcatacatggaaaccttcacgtcgtcgccgtacttctgtactgcgggcagagcacgaatctcatccaggcagctctcccaggtctcgcccgcggtcatgcggcggtccagggaaacggagcaggagtcggccactgcgcagcggctgggggaggtgaagaaaatctcggaaaccgtaacggttccgcggcccaggaagttggcttccttgtactcggggttgtatttctcatccagcattttcacaaggcccttgacttccttgtcgtcggcagcgtcgttctcgttgagagcgcgcacgtcctgaaggatgtcggccatcttgtagatggcgttgtcgccgcgctcgggagcggagccgtggcaggaaacgcccttgacgtccacgcgaatctccatacggcctctctggccgcggtagatgccgccgtcggtgggctcggtggaaaccacgaagtccggacggaccttgtcttcgttgatgatgtactgccagcacaggccgtcgcagtcctcttcctgaaccgtaccagttactaatacggtgtatttgtcggagagcagtcccagatccttcatgatcttagcgccgtaaaccgcgcttacgataccgccgcactggtcggacacgccgcgtccgccgatctcggtgtcgttctcgtatccctcgtagggatcgaagttccagttgttcttgttgccgatgccaacggtgtcgatgtgggcgtcaaacccgattaaggtcttgccggtgcccatgtatcccagcacgttgcccatgggatcgatctcgaccttgtcgaaatccagctttctcatctcctgtgcaatgcggtcgatgtgagctttctcatcgcagctctcgccggggaattttacgatgtcgcgtaaaaatttggtcatgtctttctcgtagttctgtgcagcttccttgattttgccataatccaggctcattttgatttcctccataaatatgttttgtgattggtttttatatgaaactgtttatttctctttgccttcccagacgatgttcttgtagcggtccggatcggtgtcgccctcggtggagaagagcagtaccctggaattctcatccagaccgatggcctggcgcagatccttgtaatcgtccatggtggtcatggcggccagggctccgaagggagcggctccggattcgccggaggtaacaggcgcgtcgcccttaatgggagcggccagcatgcgcatgccctttgcggctacccagtcgggagctgcgatgaatacggttacgtggttctttaagatatcccaggagatggtgttgggctctccgcaggcgaggccggccatgatggtctgcatgtcgccgtccacaatgcggggatcaccgtctccggctgccgcgcccttatacaggcaggctgccacatcggcttccaccactacgaaggtgggaggattgtcggggtaaaggttggtgaaatatcctacaaccgcgccggctaaggagcctacgccggcctgaacgaacacgtgggtggggcggtcgcagccgtaatctttcagctgttcaccggcctccatggccatggtgccgtagccctgcatgatccaggagggaatctcctcgtagccgtcccaggcggtatcctgaacgatcacgccgcgctcggtctcctccgcttcctttgcggccagacgcacgcagtcgtcgtagttcatctcctgaatgtcaacctgagcgccctcctttgcgatgttctcaaggcgggtctgagtggaacccttgggcatatgtaccaccgccttctggcctaaacggttggcagaccaggcgacgccgcggccgtggttgccgtcggtggcggtgaagaaggtggcctgaccgaattcctcacggagtttgtcggaggtgagcaccgcgtagggcagttcggaaacgtcctttccggtctcgctggcgatgaagcgggccattgcgaaggaaccgcccagcaccttgaatgcgtttaatccgaaccggtaggactcgtccttgatgtaaacttccttcactcccaggtaagcggccatctggtccagcttggtgagaggggttttgctgtactgggggaagctctcgtggaaggttctggccttcttgatttcttccaatcccataatcggcagattcgtatccgcagttttgggcattttatttaccgcccacttgatctgttccattgttattaaatcctccttataatcatgcgtttgttttaataggaatagagttgttaacaggattgtttaattgtccgttttgcggctgttcacatcgatgtaactgtacaaagtgaattttgagatcccgaagtacttggagatcttgtcgccggacttggtaatcaggaacgctcccgcgtcgtttaagaactggatcgccgctaccttttcctctttattcataagagcggccggctttccaatcataagcacggattgttcgatcaggctgtcgagcaggtcggtgacgttggtgacgatctgatccggctgctttttcgcatccgattggggttcggtatcgatcagcgctttgatcgcccggtccactgtcatcagcccggtaatgtcgaagttgatcgccagtatgtagtcgatggcgtcgccctcctcattatgaatatagaaggtgctggattttaagatccgcccgttggctgagcgggtcagataacccagatggtctttgagagaagccgcgtccttgttgtgaagggtttccaacacgaccttggacgggccgtcgccgacctggcggttggtgatatgtccattggtaatgtatacgatggaatgctccatgtcatgctttttcaaatcatggatcaccacttcacaatcaggaccgaactgtctggaaaggccgtcggctatctgggtcaggagccctaatgtgtaagtcataagcattttctcctttccttcaggattcttcaaaattaggtaactttgtacaataaacacgattgttaattttgcctcgttgtttatgattccatcatatcacaaaaaaatggaattgcaatacttttttacaaaaaaatttttgatatctaaaaaattttgcattttctgcttgcaaatgccggttacaggtgttagtataggggtacagggaggcacattctgcttaaaaagcagagatatgaatggcagagtgtgaccgatcagaaatgtgattcagaaacaggaagaaaaccatcatcgagtaaaggagagaggttatgttagtaattggcaatggacggttagtgacaagggatccggcggttcctttctatgagaacggcgcggtggcaatggacggcggcaccatcgtgcgggtcggaactgcggaggacgtcagaaaggaattcccggaggcagagtatgtggacgccagggggggcgtgatcatgcctgcgttcatcaacacccatgagcacatctacagcgccatggcgagaggactttcgattaatggatacaatcccaacggctttctggagattctggacggcatgtggtggaccatcgaccgccacctgaccaacgagcagacccgccagagcgcccgggctacctatattgactccatcaagaacggcgtcaccacggtgttcgatcaccacgccagcttcggcgagatccacgacagcctgttcgccatcgaggacgcggctaaggaactgggaatccgcacctgcctgtgctatgaggtttccgaccgcgacgggatggacaaggcgaaggaagccgtgatggagaacgcggcctggatcaagcacgccctggccgacgacacggacatgatcgccggaatgatgggcatgcacgcccagttcaccatctccgacgccaccatggagctggccgcggccaacaagcccgccgaggtgggctaccacatccatgtggccgagggcatcgaggacctgcacgactgcctgaagaaatacggcaagcgcattgtggaccgcctctacgactgcaacatcctgggaagcaagaccttgcttgggcactgcatctacgtgaacccccacgagatggaattaattaaggaaacggataccatggtggtacataatcccgagtccaacatgggcaacgcctgcggctgcccgcccaccatggagattgtgcaccggggaatcttaaccggccttggcacggacggctacacccacgatgtgctggagtcctacaaggtggccaacgtgctgcacaagcaccacctctgcgatccgggcgcagcctggagcgaggtgccgcagatgctctttgagggcaacccccagatcgcaaaccgctacttcaagaagcagctgggcgttctgaaggagggagcggccgcggacgtgatcgtcaccgactatatcccgctgacccccatggatgcgagcaacatcaacggccacatcctcttcggtatgaccggacgcagcgtggtgaccacggtctgcaacggtaagatcctgatgaaggaccgtgagctgatcggcatcgacgaggagaaggtgatggcggaagtgagagcggaggcaaagaagctggagcgctccatcaacggctgacaatatctgaatataatttaggaggaaatttccatgagcgatagaatgaccccgattccctttgggaatctgatgaactggattttgaaggaacacaagaagggcgccatcttcggcgtgcgccgtccctttgtggcggatccgtcccatacatacgagattttcggccgtaagctggagactcccttcggccctgcggccggcccccatacccagctggcccagaacatcgtggcgtcctacgtggccggcagccggttctttgagctgaagaccgtgcagaagctggacggcgaggatcttccggtgaacaagccctgtatcaaggccgacgacgagtgctacaactgcgagtggtccaccgagctgtacgtgccccaggcatttgacgagtatgtgaaggcctggttcgcctgccaggtggtggccaaggagtacggtctgggcgccatggacggcttccagttcaatatgtccgtgggttacgacctggagggcatcaaactggaaaaaattgacaagtttatcgagggcatgaaggatgcctccgagacgcctgttttcaaagagtgccgccagtggctgttggacaacgcggacctgtttgagaaggtgacgaaggaggacatcgagggcatttccccggaagtctgcaactgcgcaaccctgtccaccctccacggctgcccgcctcaggagatcgagcgcatcgcccgctacctgatcgaggagaagaaggttcacaccttcatcaagtgcaaccccaccctgctgggttacgagtacgcaagagatatgatggattccatgggctacgactatgtggccttcggcgacttccatttcaaggacgatttacagtacagcgacgcggtgcccatgctggagcgcttacaggctctggccggcgagaagggcctggagttcggcgtgaagatcaccaacaccttccccgtggacgtgaaggcgggagagcttcccagcgaggaaatgtatatgtccggaaagagcctgtacccgctgtccatgtccgttgccatgaagctggcaagggatttcggcggaaagctgcgcatctcctactccggcggagccgactatttcaatattaaggatatcgtggacgcgggcatctggcctgtgaccatggcaaccaccatgttaaagcccggaggctaccagagactggagcagatcggacagatcttcgcaaaggacgaggccaaagcctttgagggtgttgacgcagaacgcgtggcccagctggtggaagcggctaagaccgacaagcaccatgtgaaggccgtaaaaccccttccctccagaaagatcaagcgcccggtgccgctgaccgactgtttcgtggctccctgcgaggagggctgccccatccaccaggatatcaccacgtatttgaagctcatgggagcggggaaggccgaggaggccctggaggtcattttgctgaagaaccccctgccctttatcaccggcaccatctgcgcccacaactgcatgagcaaatgtacccgtaacttctacgagaccccggtgaacatccgcagaaccaaactggaagccgccgagggcggatttgaggccgtgatggcgaagctcaaaaagccggagatcacaagcggcaagaccgcagccgtggtgggcggaggcccggccggcatggcggccgcctatttcctggccaggggcggcgtgaagacgacgctgtttgagaaggaggagaagctgggcggcgtggtccgcaacgtgattccgggcttccgtatctccgacgaggccatcgacaacgacgcgaagctgatcgaggccatgggcgtggagatcgtcaccggccgggagatcggttccgtggacgaggtgaagaaggactacgactacgtggtgctggccctgggcgcttccacgccgggcgtactgcgtctggagaaggggcaggctatgaacgcgctggaattcctggcacagtttaaggccacggacggaaatctggacctgggcgagaacgtggtggtcatcggcggaggaaacaccgccatggataccgcccgcgccgcaaagcgcaacaagggcgtgaagaaggtttccctggtataccgccggaccaagcgctatatgccggccgacgccgaggagctggagatggccattgaggacggcgtggagttcgcggagctgctcagccctgtgaagctggagaacggtgtgctctactgtaagaagatggtgctgggcgactacgacgccagcggacgccggggcgtggtggagaccgacgaggtggttgaggttcccgccgatacggtgatcgccgctgtgggcgagaaggttccgggggcgttctacgaggccaacggtattgccctggacaacagaggccgggtgcaggcagatcaggagaccttagagaccagcgttgcgggcgtttacgctgcgggcgacgggctctacggacccgctaccgtggtggagggaatccgcgacggcatgaaggcggccgaggccattctgggccgtgccgtggctgaggacctgttcagcctgtccgacgaggagaagatttacggccgcaagggcaacctgatggaggaggacgggaaggacgtggacagcaagcgctgcctgtcctgcaacagctactgcgagaactgcgtggaggtatgtcccaaccgggccaatatcaccctgaccgtgccgggcatggagcgccaccagatcattcacgttgactatatgtgcaacgagtgcggcaactgcaagagcttctgtccctgggacagcgccccctacttagataagttcaccctgttcgccaacgagaaggatatggaggacagcaagaaccagggcttcgtggtgttagaccgggagaccggggcctgcaaggtgcgcctgcagggcaaggtgacggattacgtggccggaaccgcaagcgatgtggtgccggagggaatcgcaaagatcatcgggaccgtgatccgggattacgcctatatgctgtaaagactggttttgggcggcgttgaccggccttctgaaaaaaggccgggtcccgccgcatatttggaacaggctcgggagttttttgccgcaaggcagagtctcccgggcagtttacgcaggaacacgttaaaaaaataacaaaactttttgagacggaacataactgtggagaacgatacgggccgcctggaggcggtttgtttaagccatagaatgatagaatttctaaagccactgtaaattggattgggattggccgggagaggaggggaccgccgtggcgcgcgtgaaaaccatgaaggttgtgataacatttccggggaccacccaggcgctgcggatggagaaggaagcgcgggagcgcggacttgccggacgtctgattcccgtaccgtcggcgatccgggcgggctgcggtatggcctggagcgcgccggtggaagcccggggccaattagaatctctgttggagacgacggggatagaactggaggatatttatgagttcttattgtaaagtgtggattaacggccaggagatcgaagcggacgcggaccgcaagctgatcgacgtgctgagaaacgactgccgcttaaagtccgtgaaggacggctgcagcgagggcgcctgcggaacctgtacggtgctggtggacggaaaagccaccaaggcctgcgtgcagaagatggggcgcatggagggaaagcacattctcaccgtggaggggttcagccagcgtgaaaaggatgtgtacgtatacgctttcggtcaggcgggagcagtacagtgcggtttttgtattcccggcatggtgatctgcgctaaggggctgctggatgtgaatcccaaccccagccgtgtggagatcgcccacgccatccgcaacaactactgccggtgcacgggctacaagaagattatcgacgccattgagctggcggcaaaaatgctgcgggaggacacccggctggatgagcaggagaagatggtcaaggtcggctcccggatgcaccgcatcgacgtggagggcaaggtgctcggcaccggccagtacgtggacgacatggaccaggtggacctgccgggaatgatctacggcagcgcggtgcgggccaaatacccgcgggcgctggtgaaggatatccgcacggagaaggccaaagcccttcccggcgtggtctgtgtgctgaccgcagaggacgtgcctggcaagaataaggtgggccatctgaagcaggactgggataccatgattccggtggggggaaccacccggtatctgggcgacgccgtcgccatcgtggcggctgagactccggagattctggagcaggctaaggccctggtggaggtggattacgaggagttaaggcccgtgacctgcccggccgaggccctggcggagggcgctcccctggtgcattccaccggaaacgtgttgagccacgagcacctggtgcgcggaaacgcggaggaagtgatcgcaaattccaaatataaagtgacgaaacactatgagacgccctggaccgagcacgcattcctggagccggagtgcgccatcgcgatgccctttggggacggcgtattcatctactccacggaccagggaacctacgacacccgccacgagacctcgatccttctgggtctggatcccgacaaggtgatcgtggagaataaactggtgggcggcggcttcggcggcaaggaggacgtgaccgtgcagcaccaggcggcgctgatcgcctatctgaccaagcgtaccgtgaagtgcaggctgacccgcaaggagagcctgatcatccatcccaagcgccatcccatgagcatcgatctgaccacggcctgcgacgagaacggttatctgactgccatgaaggcggtggtggtggccgacaccggcgcgtacgcttccttaggcggcccggtgctccagagagcctgcacccatgcggcaggcccctacaattaccagaatatcgacatcgacggcaccgccgtttacaccaacaacccgccggcaggcgcgttccgcggcttcggcgtgacccagacgatctttgcgacggagatgaacctcaacctgctggctgagatggccggtctggatccctgggagatgcgctaccgcaacgccatccgtcccggacaggtgctgcccaacgggcagatcgcggacccggccaccggcctggtggaaactctggaagcggtgaaggatcagttctatgaggcgtacaacgccggtaaaccggtgggcctgggctgcgcgttaaagaacgcgggcgtgggcgtgggccttcccgacaagggccgggcgcgtctgatcgtggaggacggcaagatccacatccacgcgggcgcatcctgcatcggccagggcctgggcaccgtgctggtgcagatggtggcggagagcgccggggtcagcatggacgacatcgtctaccacaaccccaacacctccatggcccc
